(12) United States Patent
Kan et al.

(10) Patent No.: US 8,680,041 B2
(45) Date of Patent: Mar. 25, 2014

(54) GENETIC VARIATIONS ASSOCIATED WITH TUMORS

(75) Inventors: Zhengyan Kan, Redwood City, CA (US); Denise M. Kenski, San Francisco, CA (US); Brock Peters, San Francisco, CA (US); Somasekar Seshagiri, San Carlos, CA (US)

(73) Assignee: Genentech, Inc., South San Francisco, CA (US)

( * ) Notice: Subject to any disclaimer, the term of this patent is extended or adjusted under 35 U.S.C. 154(b) by 880 days.

(21) Appl. No.: 12/446,907

(22) PCT Filed: Oct. 24, 2007

(86) PCT No.: PCT/US2007/082397
§ 371 (c)(1),
(2), (4) Date: Nov. 11, 2009

(87) PCT Pub. No.: WO2008/070325
PCT Pub. Date: Jun. 12, 2008

(65) Prior Publication Data
US 2010/0055095 A1     Mar. 4, 2010

Related U.S. Application Data

(60) Provisional application No. 60/863,106, filed on Oct. 26, 2006, provisional application No. 60/917,814, filed on May 14, 2007.

(51) Int. Cl.
*A61K 31/00* (2006.01)
*A61P 35/00* (2006.01)

(52) U.S. Cl.
USPC .............................. 514/1; 514/19.2; 514/19.3

(58) Field of Classification Search
None
See application file for complete search history.

(56) References Cited

U.S. PATENT DOCUMENTS

2003/0105000 A1*   6/2003   Pero et al. ................... 514/12

OTHER PUBLICATIONS

Jimenez et al. (EMBO J. 1998 17(3): 743-753).*
Philp et al. (Can. Res. Oct. 2001, 61: 7426-7429).*
Granville et al. (Clin. Cancer Res. Feb. 1, 2006, 12(3): 679-689).*
Ibragimova and Eade (Biophysical Journal, Oct. 1999, vol. 77, pp. 2191-2198).*
Burgess et al. (J. Cell Biol. 111:2129-2138, 1990).*
Lazar et al. (Molecular and Cellular Biology, 1988, 8:1247-1252).*
Granville et al., (Clin. Cancer Res. Feb. 1, 2006, 12(3): 679-689).
Philp et al. (Cancer Res. Oct. 2001, 61: 7426-7429).
Written Opinion of the International Searching Authority in PCT Application No. PCT/US2007/082397 filed Oct. 24, 2007.
Berenjeno IM and Vanhaesebroeck B. : PI3K regulatory subunits lose control in cancer, Cancer Cell. Dec. 8, 2009;16(6):449-50.
Holt et al. "Phosphatidylinositol 3-kinase activation is mediated by high-affinity interactions between distinct domains within the p110 and p85 subunits", Mol Cell Biol. Jan. 1994;14(1):42-9.
Jaiswal et al. "Somatic mutations in p85alpha promote tumorigenesis through class IA PI3K activation", Cancer Cell. Dec. 8, 2009;16(6):463-74.
Mizoguchi et al. "Genetic alterations of phosphoinositide 3-kinase subunit genes in human glioblastomas", Brain Pathol. 14 (4):372-377, 2004.
Quayle et al. "Somatic mutations of PIK3R1 promote gliomagenesis", PLoS One. 2012;7(11):e49466.
Urick et al. "PIK3R1 (p85α) is somatically mutated at high frequency in primary endometrial cancer", Cancer Res. Jun. 15, 2011;71(12):4061-7.

* cited by examiner

*Primary Examiner* — Peter J Reddig
(74) *Attorney, Agent, or Firm* — Alex Andrus; Alissa H. Faris; Arnold & Porter LLP

(57) ABSTRACT

Nucleotide and amino acid variations associated with tumors are provided. Methods for detecting variations and for diagnosing and treating tumors are provided.

10 Claims, 50 Drawing Sheets

FIGURE 1

| VARIANT ID | UNQ ID | DNA ID | GENE | GENE DESCRIPTION (HUGO) | NT_CHGE | AA_CHGE |
|---|---|---|---|---|---|---|
| 1049 | 2295 | 103509 | AKT-1 | v-akt murine thymoma viral oncogene homolog 1 | HETSUB.1165G>C | 323D>H |
| 11228 | 2295 | 103509 | AKT-1 | v-akt murine thymoma viral oncogene homolog 1 | HETSUB.484C>T | 96R>W |
| 34129 | 2295 | 103509 | AKT-1 | v-akt murine thymoma viral oncogene homolog 1 | HETSUB.765G>T | 189K>N |
| 48337 | 2295 | 103509 | AKT-1 | v-akt murine thymoma viral oncogene homolog 1 | HOMSUB.765G>T | 189K>N |
| 21270 | 6167 | 226506 | AKT2 | v-akt murine thymoma viral oncogene homolog 2 | HETSUB.505G>T | 101R>L |
| 24683 | 6167 | 226506 | AKT2 | v-akt murine thymoma viral oncogene homolog 2 | HETSUB.471G>T | 90V>L |
| 48080 | 6520 | 188261 | ALK | anaplastic lymphoma kinase (Ki-1) | HETSUB.2369C>A | 486F>L |
| 52468 | 6520 | 188261 | ALK | anaplastic lymphoma kinase (Ki-1) | HETSUB.2664G>A | 585A>T |
| 52471 | 6520 | 188261 | ALK | anaplastic lymphoma kinase (Ki-1) | HETSUB.5371C>T | 1487S>L |
| 62942 | 6520 | 188261 | ALK | anaplastic lymphoma kinase (Ki-1) | HETSUB.2563G>A | 551R>Q |
| 1744 | 2290 | 226502 | ARAF | v-raf murine sarcoma 3611 viral oncogene homolog | HETSUB.1487G>T | 429D>Y |
| 1825 | 2290 | 226502 | ARAF | v-raf murine sarcoma 3611 viral oncogene homolog | HETSUB.1605G>A | 468G>E |
| 21222 | 2290 | 226502 | ARAF | v-raf murine sarcoma 3611 viral oncogene homolog | HOMSUB.1686A>G | 495Y>C |
| 39239 | 2290 | 226502 | ARAF | v-raf murine sarcoma 3611 viral oncogene homolog | HETSUB.1686A>G | 495Y>C |
| 42019 | 4200 | 349269 | AXIN1 | axin 1 | HETSUB.970G>T | 314G>O |
| 47109 | 4200 | 349269 | AXIN1 | axin 1 | HETSUB.875G>A | 282G>D |

FIGURE 1 (CONTINUED)

| | | | | | |
|---|---|---|---|---|---|
| 47753 | 4200 | 349269 | AXIN1 | axin 1 | HETSUB.659A>C | 210K>T |
| 57801 | 4200 | 349269 | AXIN1 | axin 1 | HETSUB.1234C>A | 402R>S |
| 61414 | 4200 | 349269 | AXIN1 | axin 1 | HETSUB.2548G>C | 840G>R |
| 47301 | 10494 | 351940 | AXIN2 | axin 2 (conductin, axil) | HETSUB.2598G>T | 837G>C |
| 47604 | 10494 | 351940 | AXIN2 | axin 2 (conductin, axil) | HETSUB.449G>T | 120M>I |
| 58101 | 10494 | 351940 | AXIN2 | axin 2 (conductin, axil) | HETSUB.2526G>T | 813A>S |
| 58308 | 10494 | 351940 | AXIN2 | axin 2 (conductin, axil) | HETSUB.862C>T | 258T>M |
| 62903 | 10494 | 351940 | AXIN2 | axin 2 (conductin, axil) | HETSUB.487C>T | 133A>V |
| 47966 | 452 | 208152 | AXL | AXL receptor tyrosine kinase | HETSUB.1913T>C | 637L>P |
| 48190 | 452 | 208152 | AXL | AXL receptor tyrosine kinase | HETSUB.1831C>T | 610R>O |
| 63193 | 6156 | 513210 | BAX | BCL2-associated X protein | HETSUB.583C>A | 172L>I |
| 19629 | 2707 | 326808 | BCL-XL | BCL2-like 1 | HETSUB.619G>T | 85A>S |
| 50324 | 2152 | 401383 | B-raf | v-raf murine sarcoma viral oncogene homolog B1 | HETSUB.1516G>T | 485L>F |
| 53270 | 2152 | 401383 | B-raf | v-raf murine sarcoma viral oncogene homolog B1 | HETSUB.1358G>T | 433E>O |
| 59665 | 2152 | 401383 | B-raf | v-raf murine sarcoma viral oncogene homolog B1 | HETSUB.2074A>G | 671R>R |
| 60390 | 2152 | 401383 | B-raf | v-raf murine sarcoma viral oncogene homolog B1 | HETSUB.1792C>T | 577L>L |
| 61456 | 2152 | 401383 | B-raf | v-raf murine sarcoma viral oncogene homolog B1 | HETSUB.1215A>G | 385D>G |
| 3465 | 9979 | 516878 | CBL | myeloid/lymphoid or mixed-lineage leukemia (trithorax homolog, Drosophila) | HETSUB.1145+2T>G | INTRONIC |
| 1188 | 14620 | 516881 | CBLB | Cas-Br-M (murine) ecotropic retroviral transforming sequence b | HETSUB.3089C>T | 923H>Y |
| 60761 | 22478 | 326714 | CBLC | Cas-Br-M (murine) ecotropic retroviral transforming sequence c | HETINS.1296C>CCA | 419Q>FS |

FIGURE 1 (CONTINUED)

| | | | | | |
|---|---|---|---|---|---|
| 20454 | 1983 | CDKN2A (isoform 2) | cyclin-dependent kinase inhibitor 2A (melanoma, p16, inhibits CDK4) | HETSUB.349G>C | 46R>P |
| 33648 | 1983 | CDKN2A (isoform 1) | cyclin-dependent kinase inhibitor 2A (melanoma, p16, inhibits CDK4) | HETSUB.488G>C | 151G>R |
| 40455 | 1983 | CDKN2A (isoform 2) | cyclin-dependent kinase inhibitor 2A (melanoma, p16, inhibits CDK4) | HETSUB.371G>A | 53M>I |
| 42941 | 1983 | CDKN2A (isoform 2) | cyclin-dependent kinase inhibitor 2A (melanoma, p16, inhibits CDK4) | HETSUB.362G>C | 50Q>H |
| 60943 | 1983 | CDKN2A (isoform 2) | cyclin-dependent kinase inhibitor 2A (melanoma, p16, inhibits CDK4) | HETSUB.511C>A | 100A>D |
| 39399 | 8258 | CIAS1 (isoform 2) | cold autoinflammatory syndrome 1 | HETSUB.1215C>G | 157R>G |
| 42354 | 8258 | CIAS1 (isoform 1) | cold autoinflammatory syndrome 1 | HETSUB.2152T>A | 469L>H |
| 42552 | 8258 | CIAS1 (isoform 1) | cold autoinflammatory syndrome 1 | HETSUB.2124C>A | 460H>N |
| 48256 | 8258 | CIAS1 (isoform 1) | cold autoinflammatory syndrome 1 | HETSUB.1801C>T | 352P>L |
| 56750 | 8258 | CIAS1 (isoform 1) | cold autoinflammatory syndrome 1 | HETSUB.1422G>T | 226G>W |
| 58209 | 8258 | CIAS1 (isoform 1) | cold autoinflammatory syndrome 1 | HETSUB.2829G>T | 695E>O |
| 58530 | 8258 | CIAS1 (isoform 1) | cold autoinflammatory syndrome 1 | HETSUB.1795C>A | 350T>K |
| 61627 | 8258 | CIAS1 (isoform 1) | cold autoinflammatory syndrome 1 | HETSUB.2730G>A | 662D>N |

FIGURE 1 (CONTINUED)

| | | | | |
|---|---|---|---|---|
| 61648 | 8258 | 347968 | CIAS1 (isoform 1) | cold autoinflammatory syndrome 1 | HETSUB.2476T>G | 577V>G |
| 61663 | 8258 | 347968 | CIAS1 (isoform 1) | cold autoinflammatory syndrome 1 | HETSUB.2653A>T | 636E>V |
| 20439 | 42 | 398842 | cMet | met proto-oncogene (hepatocyte growth factor receptor) | HETSUB.264G>T | 26C>F |
| 45237 | 42 | 398842 | cMet | met proto-oncogene (hepatocyte growth factor receptor) | HETSUB.503A>G | 106N>D |
| 47993 | 42 | 398842 | cMet | met proto-oncogene (hepatocyte growth factor receptor) | HETSUB.763C>A | 192F>L |
| 48958 | 42 | 398842 | cMet | met proto-oncogene (hepatocyte growth factor receptor) | HETSUB.2184A>G | 666Y>C |
| 49423 | 42 | 398842 | cMet | met proto-oncogene (hepatocyte growth factor receptor) | HETSUB.2208T>G | 674L>O |
| 49952 | 42 | 398842 | cMet | met proto-oncogene (hepatocyte growth factor receptor) | HETSUB.3695C>T | 1170R>O |
| 50550 | 42 | 398842 | cMet | met proto-oncogene (hepatocyte growth factor receptor) | HETSUB.3683C>T | 1166R>O |
| 57867 | 42 | 398842 | cMet | met proto-oncogene (hepatocyte growth factor receptor) | HETSUB.1757C>T | 524Q>O |
| 61708 | 42 | 398842 | cMet | met proto-oncogene (hepatocyte growth factor receptor) | HETSUB.3378A>G | 1064Q>R |

FIGURE 1 (CONTINUED)

| | | | | | |
|---|---|---|---|---|---|
| 63708 | 42 | 398842 | cMet | met proto-oncogene (hepatocyte growth factor receptor) | HETSUB.1218G>T | 344G>V |
| 48913 | 1975 | 226176 | CXCR4 | chemokine (C-X-C motif) receptor 4 | HETSUB.596C>G | 170P>X |
| 49180 | 1975 | 226176 | CXCR4 | chemokine (C-X-C motif) receptor 4 | HETSUB.1034G>A | 316A>T |
| 42025 | 1794 | 208132 | DDR2 | discoidin domain receptor family, member 2 | HETSUB.2538A>C | 763K>T |
| 43879 | 1794 | 208132 | DDR2 | discoidin domain receptor family, member 2 | HETSUB.1581G>T | 444S>I |
| 47978 | 1794 | 208132 | DDR2 | discoidin domain receptor family, member 2 | HETSUB.534A>G | 95H>R |
| 48035 | 1794 | 208132 | DDR2 | discoidin domain receptor family, member 2 | HETSUB.2098G>T | 616K>N |
| 58143 | 1794 | 208132 | DDR2 | discoidin domain receptor family, member 2 | HETSUB.2558G>T | 770V>L |
| 24752 | 28426 | 513229 | DUBA2 | OTU domain containing 6A | HETSUB.591T>A | 186L>Q |
| 25271 | 28426 | 513229 | DUBA2 | OTU domain containing 6A | HETSUB.482G>A | 150G>S |
| 31451 | 28426 | 513229 | DUBA2 | OTU domain containing 6A | HETSUB.356C>A | 108R>S |
| 32342 | 28426 | 513229 | DUBA2 | OTU domain containing 6A | HETSUB.182C>G | 50R>G |
| 60791 | 28426 | 513229 | DUBA2 | OTU domain containing 6A | HETSUB.387C>T | 118S>L |
| 41814 | 2395 | 354686 | EDG1 | endothelial differentiation, sphingolipid G-protein-coupled receptor, 1 | HETSUB.897G>T | 282C>F |
| 47493 | 2395 | 354686 | EDG1 | endothelial differentiation, sphingolipid G-protein-coupled receptor, 1 | HETSUB.809G>T | 253A>S |
| 48130 | 9424 | 216539 | EGFL11 | EGF-like-domain, multiple 11 | HETSUB.633C>A | 79P>H |
| 49336 | 9424 | 216539 | EGFL11 | EGF-like-domain, multiple 11 | HETSUB.942T>G | 182F>C |
| 49363 | 9424 | 216539 | EGFL11 | EGF-like-domain, multiple 11 | HETSUB.1145+2T>C | INTRONIC |

FIGURE 1 (CONTINUED)

| | | | | | |
|---|---|---|---|---|---|
| 49432 | 9424 | 216539 | EGFL11 | EGF-like-domain, multiple 11 | HETSUB.810C>A | 138S>Y |
| 57447 | 9424 | 216539 | EGFL11 | EGF-like-domain, multiple 11 | HETSUB.753C>A | 119T>K |
| 57642 | 9424 | 216539 | EGFL11 | EGF-like-domain, multiple 11 | HETSUB.1113C>A | 239A>E |
| 57648 | 9424 | 216539 | EGFL11 | EGF-like-domain, multiple 11 | HETSUB.882G>T | 162G>V |
| 61381 | 9424 | 216539 | EGFL11 | EGF-like-domain, multiple 11 | HETSUB.645A>C | 83Q>P |
| 503 | 1033 | 401352 | EGFR | epidermal growth factor receptor (erythroblastic leukemia viral (v-erb-b) oncogene homolog, avian) | HOMSUB.906C>T | 220S>S |
| 3561 | 1033 | 401352 | EGFR | epidermal growth factor receptor (erythroblastic leukemia viral (v-erb-b) oncogene homolog, avian) | HOMDEL.2481GGAATTA AGAGAAGC> | 745KELREA>K |
| 8278 | 1033 | 401352 | EGFR | epidermal growth factor receptor (erythroblastic leukemia viral (v-erb-b) oncogene homolog, avian) | HETSUB.906C>T | 220S>S |
| 18069 | 1033 | 401352 | EGFR | epidermal growth factor receptor (erythroblastic leukemia viral (v-erb-b) oncogene homolog, avian) | HETSUB.2745G>T | 833L>F |
| 22617 | 1033 | 401352 | EGFR | epidermal growth factor receptor (erythroblastic leukemia viral (v-erb-b) oncogene homolog, avian) | HETSUB.3791A>T | 1182K>M |
| 25259 | 1033 | 401352 | EGFR | epidermal growth factor receptor (erythroblastic leukemia viral (v-erb-b) oncogene homolog, avian) | HETSUB.2516A>T | 757K>M |

FIGURE 1 (CONTINUED)

| | | | | | |
|---|---|---|---|---|---|
| 39041 | 1033 | 401352 | EGFR | epidermal growth factor receptor (erythroblastic leukemia viral (v-erb-b) oncogene homolog, avian) | HETDEL.2481GGAATTA AGAGAAGC> | 745KELREA>K |
| 39042 | 1033 | 401352 | EGFR | epidermal growth factor receptor (erythroblastic leukemia viral (v-erb-b) oncogene homolog, avian) | HETDEL.2483AATTAAG AGAAGCAACATC> | 746>FS |
| 41329 | 1033 | 401352 | EGFR | epidermal growth factor receptor (erythroblastic leukemia viral (v-erb-b) oncogene homolog, avian) | HETSUB.691C>T | 149R>W |
| 43418 | 1033 | 401352 | EGFR | epidermal growth factor receptor (erythroblastic leukemia viral (v-erb-b) oncogene homolog, avian) | HETSUB.593C>T | 116S>F |
| 45939 | 1033 | 401352 | EGFR | epidermal growth factor receptor (erythroblastic leukemia viral (v-erb-b) oncogene homolog, avian) | HETSUB.1525C>T | 427R>C |
| 46170 | 1033 | 401352 | EGFR | epidermal growth factor receptor (erythroblastic leukemia viral (v-erb-b) oncogene homolog, avian) | HETSUB.2257C>T | 671R>C |
| 46653 | 1033 | 401352 | EGFR | epidermal growth factor receptor (erythroblastic leukemia viral (v-erb-b) oncogene homolog, avian) | HETSUB.2007C>T | 587D>D |

FIGURE 1 (CONTINUED)

| | | | | | |
|---|---|---|---|---|---|
| 46815 | 1033 | 401352 | EGFR | epidermal growth factor receptor (erythroblastic leukemia viral (v-erb-b) oncogene homolog, avian) | HETSUB.1067C>T | 274T>M |
| 48406 | 1033 | 401352 | EGFR | epidermal growth factor receptor (erythroblastic leukemia viral (v-erb-b) oncogene homolog, avian) | HOMDEL.2523C> | 759>FS |
| 48769 | 1033 | 401352 | EGFR | epidermal growth factor receptor (erythroblastic leukemia viral (v-erb-b) oncogene homolog, avian) | HETSUB.748G>A | 168V>I |
| 48832 | 1033 | 401352 | EGFR | epidermal growth factor receptor (erythroblastic leukemia viral (v-erb-b) oncogene homolog, avian) | HETSUB.740G>A | 165R>Q |
| 54515 | 1033 | 401352 | EGFR | epidermal growth factor receptor (erythroblastic leukemia viral (v-erb-b) oncogene homolog, avian) | HETSUB.856G>A | 204E>K |
| 56867 | 1033 | 401352 | EGFR | epidermal growth factor receptor (erythroblastic leukemia viral (v-erb-b) oncogene homolog, avian) | HETSUB.2790G>A | 848P>P |
| 56978 | 1033 | 401352 | EGFR | epidermal growth factor receptor (erythroblastic leukemia viral (v-erb-b) oncogene homolog, avian) | HETSUB.984C>T | 246S>S |

FIGURE 1 (CONTINUED)

| | | | | | |
|---|---|---|---|---|---|
| 62480 | 1033 | 401352 | EGFR | epidermal growth factor receptor (erythroblastic leukemia viral (v-erb-b) oncogene homolog, avian) | HETSUB.2605C>A | 787Q>K |
| 68160 | 1033 | 401352 | EGFR | epidermal growth factor receptor (erythroblastic leukemia viral (v-erb-b) oncogene homolog, avian) | HETDEL.2498CATCTCCGAAAGCCAACAAGGAAA> | 751TSPKANKEI>I |
| 71325 | 1033 | 401352 | EGFR | epidermal growth factor receptor (erythroblastic leukemia viral (v-erb-b) oncogene homolog, avian) | HETINS.2554G>GCCAGCGTGG | 770D>ASVD |
| 14413 | 974 | 513202 | ERBB3 | v-erb-b2 erythroblastic leukemia viral oncogene homolog 3 (avian) | HETSUB.503G>T | 104V>L |
| 21276 | 974 | 513202 | ERBB3 | v-erb-b2 erythroblastic leukemia viral oncogene homolog 3 (avian) | HETSUB.2333G>A | 714V>M |
| 43376 | 974 | 513202 | ERBB3 | v-erb-b2 erythroblastic leukemia viral oncogene homolog 3 (avian) | HETSUB.1801G>A | 536L>L |
| 46092 | 974 | 513202 | ERBB3 | v-erb-b2 erythroblastic leukemia viral oncogene homolog 3 (avian) | HETSUB.1166G>A | 325G>R |
| 46128 | 974 | 513202 | ERBB3 | v-erb-b2 erythroblastic leukemia viral oncogene homolog 3 (avian) | HETSUB.1043G>A | 284G>R |
| 46155 | 974 | 513202 | ERBB3 | v-erb-b2 erythroblastic leukemia viral oncogene homolog 3 (avian) | HETSUB.977C>T | 262P>S |

FIGURE 1 (CONTINUED)

| | | | | | |
|---|---|---|---|---|---|
| 46722 | 974 | 513202 | ERBB3 | v-erb-b2 erythroblastic leukemia viral oncogene homolog 3 (avian) | HETSUB.770C>T | 193R>O |
| 46737 | 974 | 513202 | ERBB3 | v-erb-b2 erythroblastic leukemia viral oncogene homolog 3 (avian) | HETSUB.1077T>C | 295V>A |
| 46818 | 974 | 513202 | ERBB3 | v-erb-b2 erythroblastic leukemia viral oncogene homolog 3 (avian) | HETSUB.4096G>A | 1301Q>Q |
| 48772 | 974 | 513202 | ERBB3 | v-erb-b2 erythroblastic leukemia viral oncogene homolog 3 (avian) | HETSUB.888C>T | 232A>V |
| 48823 | 974 | 513202 | ERBB3 | v-erb-b2 erythroblastic leukemia viral oncogene homolog 3 (avian) | HETSUB.3683A>G | 1164T>A |
| 48847 | 974 | 513202 | ERBB3 | v-erb-b2 erythroblastic leukemia viral oncogene homolog 3 (avian) | HETSUB.372T>A | 60M>K |
| 54581 | 974 | 513202 | ERBB3 | v-erb-b2 erythroblastic leukemia viral oncogene homolog 3 (avian) | HETSUB.1489C>T | 432I>I |
| 59575 | 974 | 513202 | ERBB3 | v-erb-b2 erythroblastic leukemia viral oncogene homolog 3 (avian) | HETSUB.1667G>C | 492D>H |
| 62615 | 974 | 513202 | ERBB3 | v-erb-b2 erythroblastic leukemia viral oncogene homolog 3 (avian) | HETSUB.978C>A | 262P>H |
| 62669 | 974 | 513202 | ERBB3 | v-erb-b2 erythroblastic leukemia viral oncogene homolog 3 (avian) | HETSUB.2619A>G | 809Q>R |

FIGURE 1 (CONTINUED)

| | | | | | |
|---|---|---|---|---|---|
| 63244 | 974 | 513202 | ERBB3 | v-erb-b2 erythroblastic leukemia viral oncogene homolog 3 (avian) | HETSUB.2730G>T | 846S>I |
| 518 | 2758 | 115980 | ERBB4 | v-erb-a erythroblastic leukemia viral oncogene homolog 4 (avian) | HETSUB.779G>C | 249C>S |
| 998 | 2758 | 115980 | ERBB4 | v-erb-a erythroblastic leukemia viral oncogene homolog 4 (avian) | HETSUB.2488C>A | 819L>M |
| 22644 | 2758 | 115980 | ERBB4 | v-erb-a erythroblastic leukemia viral oncogene homolog 4 (avian) | HETSUB.1885C>T | 618H>Y |
| 22674 | 2758 | 115980 | ERBB4 | v-erb-a erythroblastic leukemia viral oncogene homolog 4 (avian) | HETSUB.299T>C | 89V>A |
| 22677 | 2758 | 115980 | ERBB4 | v-erb-a erythroblastic leukemia viral oncogene homolog 4 (avian) | HETSUB.301G>A | 90A>T |
| 23115 | 2758 | 115980 | ERBB4 | v-erb-a erythroblastic leukemia viral oncogene homolog 4 (avian) | HETSUB.2181T>G | 716T>T |
| 41302 | 2758 | 115980 | ERBB4 | v-erb-a erythroblastic leukemia viral oncogene homolog 4 (avian) | HETSUB.1183A>G | 384I>V |
| 45987 | 2758 | 115980 | ERBB4 | v-erb-a erythroblastic leukemia viral oncogene homolog 4 (avian) | HETSUB.3781C>T | 1250R>W |
| 46068 | 2758 | 115980 | ERBB4 | v-erb-a erythroblastic leukemia viral oncogene homolog 4 (avian) | HETSUB.1414A>G | 461T>A |

FIGURE 1 (CONTINUED)

| | | | | | |
|---|---|---|---|---|---|
| 46215 | 2758 | 115980 | ERBB4 | v-erb-a erythroblastic leukemia viral oncogene homolog 4 (avian) | HETSUB.1292T>G | 420L>R |
| 46257 | 2758 | 115980 | ERBB4 | v-erb-a erythroblastic leukemia viral oncogene homolog 4 (avian) | HETSUB.3547G>T | 1172V>F |
| 46287 | 2758 | 115980 | ERBB4 | v-erb-a erythroblastic leukemia viral oncogene homolog 4 (avian) | HETSUB.1516A>C | 495N>H |
| 46581 | 2758 | 115980 | ERBB4 | v-erb-a erythroblastic leukemia viral oncogene homolog 4 (avian) | HETSUB.92T>C | 20V>A |
| 46617 | 2758 | 115980 | ERBB4 | v-erb-a erythroblastic leukemia viral oncogene homolog 4 (avian) | HETSUB.1495C>T | 488R>W |
| 46686 | 2758 | 115980 | ERBB4 | v-erb-a erythroblastic leukemia viral oncogene homolog 4 (avian) | HETSUB.2253A>C | 740E>D |
| 46725 | 2758 | 115980 | ERBB4 | v-erb-a erythroblastic leukemia viral oncogene homolog 4 (avian) | HETSUB.3935A>G | 1301Y>C |
| 46773 | 2758 | 115980 | ERBB4 | v-erb-a erythroblastic leukemia viral oncogene homolog 4 (avian) | HETSUB.535C>T | 168R>W |
| 46821 | 2758 | 115980 | ERBB4 | v-erb-a erythroblastic leukemia viral oncogene homolog 4 (avian) | HETSUB.486G>T | 151Q>H |
| 48430 | 2758 | 115980 | ERBB4 | v-erb-a erythroblastic leukemia viral oncogene homolog 4 (avian) | HETSUB.2565G>T | 844L>F |

FIGURE 1 (CONTINUED)

| | | | | | |
|---|---|---|---|---|---|
| 48433 | 2758 | 115980 | ERBB4 | v-erb-a erythroblastic leukemia viral oncogene homolog 4 (avian) | HETDEL.2566G> | 845>FS |
| 48883 | 2758 | 115980 | ERBB4 | v-erb-a erythroblastic leukemia viral oncogene homolog 4 (avian) | HETSUB.2653G>T | 874E>O |
| 48889 | 2758 | 115980 | ERBB4 | v-erb-a erythroblastic leukemia viral oncogene homolog 4 (avian) | HETSUB.2670A>C | 879G>G |
| 53759 | 2758 | 115980 | ERBB4 | v-erb-a erythroblastic leukemia viral oncogene homolog 4 (avian) | HETSUB.2822C>A | 930P>H |
| 53933 | 2758 | 115980 | ERBB4 | v-erb-a erythroblastic leukemia viral oncogene homolog 4 (avian) | HETSUB.325C>A | 98P>T |
| 53936 | 2758 | 115980 | ERBB4 | v-erb-a erythroblastic leukemia viral oncogene homolog 4 (avian) | HETSUB.657G>T | 208L>F |
| 54383 | 2758 | 115980 | ERBB4 | v-erb-a erythroblastic leukemia viral oncogene homolog 4 (avian) | HETSUB.3682G>A | 1217G>R |
| 54494 | 2758 | 115980 | ERBB4 | v-erb-a erythroblastic leukemia viral oncogene homolog 4 (avian) | HETSUB.1949C>T | 639T>M |
| 54527 | 2758 | 115980 | ERBB4 | v-erb-a erythroblastic leukemia viral oncogene homolog 4 (avian) | HETSUB.822C>A | 263P>P |
| 54584 | 2758 | 115980 | ERBB4 | v-erb-a erythroblastic leukemia viral oncogene homolog 4 (avian) | HETSUB.3591C>T | 1186P>P |

FIGURE 1 (CONTINUED)

| | | | | | |
|---|---|---|---|---|---|
| 56996 | 2758 | 115980 | ERBB4 | v-erb-a erythroblastic leukemia viral oncogene homolog 4 (avian) | HETSUB.2470G>A | 813D>N |
| 60368 | 2758 | 115980 | ERBB4 | v-erb-a erythroblastic leukemia viral oncogene homolog 4 (avian) | HETSUB.3167G>T | 1045R>M |
| 62305 | 2758 | 115980 | ERBB4 | v-erb-a erythroblastic leukemia viral oncogene homolog 4 (avian) | HETSUB.1291C>T | 420L>L |
| 62317 | 2758 | 115980 | ERBB4 | v-erb-a erythroblastic leukemia viral oncogene homolog 4 (avian) | HETSUB.3200A>T | 1056Y>F |
| 63370 | 2758 | 115980 | ERBB4 | v-erb-a erythroblastic leukemia viral oncogene homolog 4 (avian) | HETSUB.3850C>T | 1273R>W |
| 40143 | 1477 | 342173 | ETBR | endothelin receptor type B | HETDEL.1114T> | 293>FS |
| 6736 | 527 | 344519 | FGFR1 | fibroblast growth factor receptor 1 (fms-related tyrosine kinase 2, Pfeiffer syndrome) | HETSUB.2094G>T | 456M>I |
| 51801 | 527 | 344519 | FGFR1 | fibroblast growth factor receptor 1 (fms-related tyrosine kinase 2, Pfeiffer syndrome) | HETSUB.2750G>A | 675R>Q |
| 65700 | 527 | 344519 | FGFR1 | fibroblast growth factor receptor 1 (fms-related tyrosine kinase 2, Pfeiffer syndrome) | HETDEL.3060C> | 778>FS |

FIGURE 1 (CONTINUED)

| | | | | | |
|---|---|---|---|---|---|
| 25094 | 942 | FGFR2 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | HETSUB.2285G>A | 584E>K |
| 25295 | 513191 | FGFR2 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | HETSUB.2265-47G>C | INTRONIC |
| 25298 | 513191 | FGFR2 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | HETSUB.2265-23G>A | INTRONIC |
| 41110 | 513191 | FGFR2 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | HETSUB.2239T>G | 568N>K |

FIGURE 1 (CONTINUED)

| | | | | | |
|---|---|---|---|---|---|
| 51435 | 942 | 513191 | FGFR2 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) | HETSUB.2123G>A | 530A>T |
| 43654 | 1186 | 513192 | FGFR3 | fibroblast growth factor receptor 3 (achondroplasia, thanatophoric dwarfism) | HETSUB.752G>A | 238R>Q |
| 59653 | 1186 | 513192 | FGFR3 | fibroblast growth factor receptor 3 (achondroplasia, thanatophoric dwarfism) | HETSUB.2151C>G | 704F>L |
| 59726 | 1186 | 513192 | FGFR3 | fibroblast growth factor receptor 3 (achondroplasia, thanatophoric dwarfism) | HETSUB.2174G>A | 712R>H |
| 66719 | 1186 | 513192 | FGFR3 | fibroblast growth factor receptor 3 (achondroplasia, thanatophoric dwarfism) | HETSUB.1134G>T | 365E>D |
| 49258 | 1646 | 513203 | FGFR4 | fibroblast growth factor receptor 4 | HETSUB.2321-1G>T | INTRONIC |
| 50030 | 1646 | 513203 | FGFR4 | fibroblast growth factor receptor 4 | HETSUB.2158G>T | 664R>L |
| 35617 | 13642 | 513212 | FRAP1 | FK506 binding protein 12-rapamycin associated protein 1 | HETSUB.6682C>G | 2201L>L |
| 35620 | 13642 | 513212 | FRAP1 | FK506 binding protein 12-rapamycin associated protein 1 | HETSUB.6687G>T | 2203G>V |
| 47061 | 16212 | 331202 | GPR73 | G protein-coupled receptor 73 | HETSUB.875C>T | 292A>V |
| 47214 | 16212 | 331202 | GPR73 | G protein-coupled receptor 73 | HETSUB.919C>T | 307R>C |
| 47550 | 16212 | 331202 | GPR73 | G protein-coupled receptor 73 | HETSUB.835C>T | 279R>C |
| 48187 | 16212 | 331202 | GPR73 | G protein-coupled receptor 73 | HETSUB.637G>A | 213E>K |

FIGURE 1 (CONTINUED)

| | | | | | |
|---|---|---|---|---|---|
| 58254 | 16212 | 331202 | GPR73 | G protein-coupled receptor 73 | HETSUB.517C>T | 173R>W |
| 61498 | 16212 | 331202 | GPR73 | G protein-coupled receptor 73 | HETSUB.592G>A | 198A>T |
| 8909 | 615 | 401384 | Her2 | v-erb-b2 erythroblastic leukemia viral oncogene homolog 2, neuro/glioblastoma derived oncogene homolog (avian) | HETSUB.2271G>A | 678R>Q |
| 46206 | 615 | 401384 | Her2 | v-erb-b2 erythroblastic leukemia viral oncogene homolog 2, neuro/glioblastoma derived oncogene homolog (avian) | HETSUB.3404G>A | 1056G>S |
| 46596 | 615 | 401384 | Her2 | v-erb-b2 erythroblastic leukemia viral oncogene homolog 2, neuro/glioblastoma derived oncogene homolog (avian) | HETSUB.2501T>A | 755L>M |
| 56924 | 615 | 401384 | Her2 | v-erb-b2 erythroblastic leukemia viral oncogene homolog 2, neuro/glioblastoma derived oncogene homolog (avian) | HETSUB.861G>A | 208S>N |
| 59047 | 615 | 401384 | Her2 | v-erb-b2 erythroblastic leukemia viral oncogene homolog 2, neuro/glioblastoma derived oncogene homolog (avian) | HETSUB.3963C>T | 1242T>M |
| 64241 | 615 | 401384 | Her2 | v-erb-b2 erythroblastic leukemia viral oncogene homolog 2, neuro/glioblastoma derived oncogene homolog (avian) | HETSUB.2844T>G | 869L>R |
| 16877 | 902 | 329563 | IGF1-R | insulin-like growth factor 1 receptor | HETSUB.3640G>A | 1199G>R |
| 53381 | 902 | 329563 | IGF1-R | insulin-like growth factor 1 receptor | HETSUB.2971G>T | 976V>L |

FIGURE 1 (CONTINUED)

| | | | | | |
|---|---|---|---|---|---|
| 59230 | 902 | 329563 | IGF1-R | insulin-like growth factor 1 receptor | HETSUB.4021G>A | 1326E>K |
| 66898 | 3144 | 227470 | JAG1 | jagged 1 (Alagille syndrome) | HETDEL.502GG> | 30>FS |
| 63696 | 8891 | 327520 | JAG2 | jagged 2 | HETSUB.616T>C | 71V>A |
| 42407 | 7982 | 328574 | JAK2 | Janus kinase 2 (a protein tyrosine kinase) | HETSUB.2478C>T | 662H>Y |
| 48119 | 7982 | 328574 | JAK2 | Janus kinase 2 (a protein tyrosine kinase) | HETSUB.1868G>T | 458E>D |
| 48226 | 7982 | 328574 | JAK2 | Janus kinase 2 (a protein tyrosine kinase) | HETSUB.1516T>C | 341V>A |
| 61840 | 7982 | 328574 | JAK2 | Janus kinase 2 (a protein tyrosine kinase) | HETSUB.2818C>T | 775P>L |
| 62456 | 7982 | 328574 | JAK2 | Janus kinase 2 (a protein tyrosine kinase) | HETSUB.3832G>A | 1113R>H |
| 62735 | 7982 | 328574 | JAK2 | Janus kinase 2 (a protein tyrosine kinase) | HETSUB.3076G>A | 861G>E |
| 42835 | 2105 | 513213 | KRAS | v-Ki-ras2 Kirsten rat sarcoma viral oncogene homolog | HETSUB.252T>A | 24I>N |
| 56131 | 3150 | 513205 | MAP2K1 | mitogen-activated protein kinase kinase 1 | HETDEL.375GGAGA> | 101>FS |
| 54898 | 11655 | 396729 | MELK | maternal embryonic leucine zipper kinase | HETSUB.1067A>T | 310Y>F |
| 54916 | 11655 | 396729 | MELK | maternal embryonic leucine zipper kinase | HETSUB.406C>T | 90P>S |
| 55173 | 11655 | 396729 | MELK | maternal embryonic leucine zipper kinase | HETSUB.311T>C | 58I>T |
| 55383 | 11655 | 396729 | MELK | maternal embryonic leucine zipper kinase | HETSUB.1003G>T | 289E>O |
| 66421 | 11655 | 396729 | MELK | maternal embryonic leucine zipper kinase | HETSUB.673T>G | 179L>V |
| 44002 | 9143 | 352688 | Notch2 | Notch homolog 2 (Drosophila) | HETSUB.5153G>A | 1633V>I |

FIGURE 1 (CONTINUED)

| | | | | | |
|---|---|---|---|---|---|
| 47589 | 9143 | 352688 | Notch2 | Notch homolog 2 (Drosophila) | HETSUB.4848G>T | 1531G>V |
| 52914 | 9143 | 352688 | Notch2 | Notch homolog 2 (Drosophila) | HETSUB.6312G>T | 2019R>L |
| 63840 | 9143 | 352688 | Notch2 | Notch homolog 2 (Drosophila) | HETSUB.6777G>A | 2174G>E |
| 47340 | 3628 | 328482 | NOTCH3 | Notch homolog 3 (Drosophila) | HETSUB.4529G>A | 1484C>Y |
| 49231 | 3628 | 328482 | NOTCH3 | Notch homolog 3 (Drosophila) | HETSUB.3940C>T | 1288R>W |
| 52510 | 3628 | 328482 | NOTCH3 | Notch homolog 3 (Drosophila) | HETSUB.4787G>A | 1570R>H |
| 52902 | 3628 | 328482 | NOTCH3 | Notch homolog 3 (Drosophila) | HETSUB.4859C>T | 1594S>L |
| 62513 | 3628 | 328482 | NOTCH3 | Notch homolog 3 (Drosophila) | HETSUB.6698G>A | 2207R>Q |
| 47322 | 485 | 225514 | NRP1 | neuropilin 1 | HETSUB.355C>A | 119L>I |
| 47643 | 485 | 225514 | NRP1 | neuropilin 1 | HETSUB.1955T>G | 652F>C |
| 47900 | 485 | 225514 | NRP1 | neuropilin 1 | HETSUB.1388G>A | 463R>H |
| 48017 | 485 | 225514 | NRP1 | neuropilin 1 | HETSUB.2350G>A | 784E>K |
| 48026 | 485 | 225514 | NRP1 | neuropilin 1 | HETSUB.668A>G | 223H>R |
| 48268 | 485 | 225514 | NRP1 | neuropilin 1 | HETSUB.703C>T | 235R>O |
| 61336 | 485 | 225514 | NRP1 | neuropilin 1 | HETSUB.2188G>T | 730G>W |
| 63891 | 485 | 225514 | NRP1 | neuropilin 1 | HETSUB.407T>C | 136I>T |
| 66091 | 485 | 225514 | NRP1 | neuropilin 1 | HETSUB.1730G>C | 577R>T |
| 44988 | 1000 | 513189 | NTC1 | Notch homolog 1, translocation-associated (Drosophila) | HETSUB.6616T>G | 2206S>A |
| 49114 | 1000 | 513189 | NTC1 | Notch homolog 1, translocation-associated (Drosophila) | HETSUB.3908G>A | 1303R>H |
| 57882 | 1000 | 513189 | NTC1 | Notch homolog 1, translocation-associated (Drosophila) | HETSUB.6760C>G | 2254P>A |
| 57918 | 1000 | 513189 | NTC1 | Notch homolog 1, translocation-associated (Drosophila) | HETSUB.7379A>G | 2460Q>R |
| 58713 | 1000 | 513189 | NTC1 | Notch homolog 1, translocation-associated (Drosophila) | HETSUB.4568A>T | 1523Q>L |
| 66106 | 1000 | 513189 | NTC1 | Notch homolog 1, translocation-associated (Drosophila) | HETSUB.7117C>T | 2373R>W |
| 52351 | 1364 | 226140 | NTRK1 | neurotrophic tyrosine kinase, receptor, type 1 | HETSUB.2012T>C | 671M>T |

FIGURE 1 (CONTINUED)

| | | | | |
|---|---|---|---|---|
| 52357 | 1364 | 226140 | NTRK1 | neurotrophic tyrosine kinase, receptor, type 1 | HETSUB.1876C>A | 626Q>K |
| 52908 | 1364 | 226140 | NTRK1 | neurotrophic tyrosine kinase, receptor, type 1 | HETSUB.1463G>A | 488G>D |
| 52920 | 1364 | 226140 | NTRK1 | neurotrophic tyrosine kinase, receptor, type 1 | HETSUB.1472T>C | 491I>T |
| 61207 | 1364 | 226140 | NTRK1 | neurotrophic tyrosine kinase, receptor, type 1 | HETSUB.1721G>T | 574R>L |
| 61990 | 1364 | 226140 | NTRK1 | neurotrophic tyrosine kinase, receptor, type 1 | HETSUB.653A>T | 218E>V |
| 62729 | 1364 | 226140 | NTRK1 | neurotrophic tyrosine kinase, receptor, type 1 | HETSUB.2231G>T | 744R>L |
| 58317 | 1365 | 226141 | NTRK2 | neurotrophic tyrosine kinase, receptor, type 2 | HETSUB.2695G>T | 782V>L |
| 62561 | 1365 | 226141 | NTRK2 | neurotrophic tyrosine kinase, receptor, type 2 | HETSUB.2467T>G | 706Y>D |
| 62627 | 1365 | 226141 | NTRK2 | neurotrophic tyrosine kinase, receptor, type 2 | HETSUB.2350C>A | 667L>M |
| 19623 | 1366 | 520002 | NTRK3 | neurotrophic tyrosine kinase, receptor, type 3 | HETSUB.1828G>T | 556E>O |
| 19635 | 1366 | 520002 | NTRK3 | neurotrophic tyrosine kinase, receptor, type 3 | HETSUB.1367-1G>A | INTRONIC |
| 42588 | 1366 | 520002 | NTRK3 | neurotrophic tyrosine kinase, receptor, type 3 | HETSUB.2497-1G>A | INTRONIC |
| 42699 | 1366 | 520002 | NTRK3 | neurotrophic tyrosine kinase, receptor, type 3 | HETSUB.1879-2A>T | INTRONIC |
| 42938 | 1366 | 520002 | NTRK3 | neurotrophic tyrosine kinase, receptor, type 3 | HETSUB.2004C>G | 614I>M |
| 46920 | 1366 | 520002 | NTRK3 | neurotrophic tyrosine kinase, receptor, type 3 | HETSUB.1023G>T | 287E>D |

FIGURE 1 (CONTINUED)

| | | | | | |
|---|---|---|---|---|---|
| 48110 | 1366 | 520002 | NTRK3 | neurotrophic tyrosine kinase, receptor, type 3 | HETSUB.428G>A | 89R>H |
| 49517 | 1366 | 520002 | NTRK3 | neurotrophic tyrosine kinase, receptor, type 3 | HETSUB.2401T>G | 747F>V |
| 51192 | 1366 | 520002 | NTRK3 | neurotrophic tyrosine kinase, receptor, type 3 | HETSUB.1967A>G | 602K>R |
| 51450 | 1366 | 520002 | NTRK3 | neurotrophic tyrosine kinase, receptor, type 3 | HETSUB.2650G>T | 830A>S |
| 56023 | 1366 | 520002 | NTRK3 | neurotrophic tyrosine kinase, receptor, type 3 | HETSUB.1396G>A | 412E>K |
| 56795 | 1366 | 520002 | NTRK3 | neurotrophic tyrosine kinase, receptor, type 3 | HETSUB.513C>A | 117S>R |
| 57158 | 1366 | 520002 | NTRK3 | neurotrophic tyrosine kinase, receptor, type 3 | HETSUB.2497-1G>T | INTRONIC |
| 58980 | 1366 | 520002 | NTRK3 | neurotrophic tyrosine kinase, receptor, type 3 | HETSUB.253G>T | 31A>S |
| 60140 | 1366 | 520002 | NTRK3 | neurotrophic tyrosine kinase, receptor, type 3 | HETSUB.1700A>G | 513N>S |
| 60311 | 1366 | 520002 | NTRK3 | neurotrophic tyrosine kinase, receptor, type 3 | HETSUB.1642C>A | 494L>M |
| 62459 | 1366 | 520002 | NTRK3 | neurotrophic tyrosine kinase, receptor, type 3 | HETSUB.636G>C | 158E>D |
| 44095 | 16971 | 338340 | OTUD1 | OTU domain containing 1 | HETSUB.1300T>A | 434Y>N |
| 48113 | 16971 | 338340 | OTUD1 | OTU domain containing 1 | HETSUB.228G>T | 76M>I |
| 49144 | 16971 | 338340 | OTUD1 | OTU domain containing 1 | HETSUB.833A>C | 278K>T |
| 20093 | 18800 | 519636 | PAK6 | p21(CDKN1A)-activated kinase 6 | HETSUB.1403G>T | 328S>I |
| 50778 | 1436 | 513204 | PDGFRB | platelet-derived growth factor receptor, beta polypeptide | HETSUB.2674C>T | 773A>V |
| 50916 | 1436 | 513204 | PDGFRB | platelet-derived growth factor receptor, beta polypeptide | HETSUB.2839C>T | 828A>V |

FIGURE 1 (CONTINUED)

| | | | | | |
|---|---|---|---|---|---|
| 55440 | 1436 | PDGFRB | platelet-derived growth factor receptor, beta polypeptide | HETSUB.2427G>A | 691D>N |
| 57266 | 1436 | PDGFRB | platelet-derived growth factor receptor, beta polypeptide | HETSUB.2295G>T | 647A>S |
| 59089 | 1436 | PDGFRB | platelet-derived growth factor receptor, beta polypeptide | HETSUB.2164-2A>T | INTRONIC |
| 62978 | 1436 | PDGFRB | platelet-derived growth factor receptor, beta polypeptide | HETSUB.2905A>T | 850D>V |
| 32048 | 15838 | PDK1 | pyruvate dehydrogenase kinase, isoenzyme 1 | HETSUB.792-2A>C | INTRONIC |
| 33706 | 15838 | PDK1 | pyruvate dehydrogenase kinase, isoenzyme 1 | HETSUB.1238G>T | 380G>C |
| 42747 | 4924 | PIK3CA | phosphoinositide-3-kinase, catalytic, alpha polypeptide | HETSUB.1568C>G | 471P>A |
| 50685 | 4924 | PIK3CA | phosphoinositide-3-kinase, catalytic, alpha polypeptide | HETSUB.1937A>G | 594K>E |
| 51456 | 4924 | PIK3CA | phosphoinositide-3-kinase, catalytic, alpha polypeptide | HETSUB.2692G>A | 845V>V |
| 51750 | 4924 | PIK3CA | phosphoinositide-3-kinase, catalytic, alpha polypeptide | HETSUB.3115G>T | 986K>N |
| 51810 | 4924 | PIK3CA | phosphoinositide-3-kinase, catalytic, alpha polypeptide | HETSUB.269C>A | 38R>S |
| 55527 | 4924 | PIK3CA | phosphoinositide-3-kinase, catalytic, alpha polypeptide | HETSUB.3061C>T | 968A>A |
| 55858 | 4924 | PIK3CA | phosphoinositide-3-kinase, catalytic, alpha polypeptide | HETSUB.2333G>A | 726E>K |
| 63813 | 4924 | PIK3CA | phosphoinositide-3-kinase, catalytic, alpha polypeptide | HETSUB.192G>A | 12G>D |
| 66964 | 4924 | PIK3CA | phosphoinositide-3-kinase, catalytic, alpha polypeptide | HETSUB.2754T>G | 866L>W |

FIGURE 1 (CONTINUED)

| | | | | | |
|---|---|---|---|---|---|
| 47187 | 5003 | 516883 | PIK3R1 | phosphoinositide-3-kinase, regulatory subunit 1 (p85 alpha) | HETSUB.895A>C | 285N>H |
| 48068 | 5003 | 516883 | PIK3R1 | phosphoinositide-3-kinase, regulatory subunit 1 (p85 alpha) | HETSUB.1084C>T | 348R>O |
| 49877 | 5003 | 516883 | PIK3R1 | phosphoinositide-3-kinase, regulatory subunit 1 (p85 alpha) | HETSUB.1763G>T | 574R>I |
| 50039 | 5003 | 516883 | PIK3R1 | phosphoinositide-3-kinase, regulatory subunit 1 (p85 alpha) | HETSUB.1623T>G | 527N>K |
| 50042 | 5003 | 516883 | PIK3R1 | phosphoinositide-3-kinase, regulatory subunit 1 (p85 alpha) | HETSUB.1732A>G | 564N>D |
| 50486 | 5003 | 516883 | PIK3R1 | phosphoinositide-3-kinase, regulatory subunit 1 (p85 alpha) | HETSUB.1988G>A | 649R>Q |
| 50694 | 5003 | 516883 | PIK3R1 | phosphoinositide-3-kinase, regulatory subunit 1 (p85 alpha) | HETSUB.1966C>T | 642R>O |
| 51309 | 5003 | 516883 | PIK3R1 | phosphoinositide-3-kinase, regulatory subunit 1 (p85 alpha) | HETSUB.2038G>A | 666E>K |
| 51612 | 5003 | 516883 | PIK3R1 | phosphoinositide-3-kinase, regulatory subunit 1 (p85 alpha) | HETSUB.2087C>T | 682A>V |
| 52429 | 5003 | 516883 | PIK3R1 | phosphoinositide-3-kinase, regulatory subunit 1 (p85 alpha) | HETSUB.526C>T | 162R>O |
| 56185 | 5003 | 516883 | PIK3R1 | phosphoinositide-3-kinase, regulatory subunit 1 (p85 alpha) | HETDEL.1182AATC> | 380>FS |
| 56188 | 5003 | 516883 | PIK3R1 | phosphoinositide-3-kinase, regulatory subunit 1 (p85 alpha) | HETSUB.1388T>C | 449L>S |
| 66584 | 5003 | 516883 | PIK3R1 | phosphoinositide-3-kinase, regulatory subunit 1 (p85 alpha) | HETSUB.1670G>T | 543R>I |
| 71322 | 5003 | 516883 | PIK3R1 | phosphoinositide-3-kinase, regulatory subunit 1 (p85 alpha) | HETINS.2047C>CTAAAG C | 669H>LKH |
| 67250 | 3473 | 590779 | PIK3R2 | phosphoinositide-3-kinase, regulatory subunit 2 (p85 beta) | HETSUB.1546G>A | 345R>Q |

FIGURE 1 (CONTINUED)

| | | | | | |
|---|---|---|---|---|---|
| 67382 | 13736 | PIK3R4 | phosphoinositide-3-kinase, regulatory subunit 4, p150 | HETSUB.2544G>A | 655E>K |
| 67451 | 13736 | PIK3R4 | phosphoinositide-3-kinase, regulatory subunit 4, p150 | HETSUB.3721C>T | 1047T>M |
| 67331 | 9122 | PIK3R5 | phosphoinositide-3-kinase, regulatory subunit 5, p101 | HETSUB.102G>A | 12R>H |
| 34015 | 3368 | PLK1 | polo-like kinase 1 (Drosophila) | HETSUB.1544C>G | 497I>M |
| 46956 | 3338 | PRKCB1 | protein kinase C, beta 1 | HETSUB.1964C>T | 610R>C |
| 47232 | 3338 | PRKCB1 | protein kinase C, beta 1 | HETSUB.1147G>A | 337M>I |
| 47421 | 3338 | PRKCB1 | protein kinase C, beta 1 | HETSUB.2106T>G | 657F>C |
| 47652 | 3338 | PRKCB1 | protein kinase C, beta 1 | HETSUB.522G>A | 129G>E |
| 48092 | 3338 | PRKCB1 | protein kinase C, beta 1 | HETSUB.1453G>T | 439K>N |
| 48259 | 3338 | PRKCB1 | protein kinase C, beta 1 | HETSUB.1086C>T | 317P>L |
| 61462 | 3338 | PRKCB1 | protein kinase C, beta 1 | HETSUB.1649C>A | 505P>T |
| 55155 | 5024 | PRKCI | protein kinase C, iota | HETSUB.1582G>T | 441R>M |
| 55401 | 5024 | PRKCI | protein kinase C, iota | HETSUB.1425G>A | 389G>S |
| 55410 | 5024 | PRKCI | protein kinase C, iota | HETSUB.807C>T | 183R>W |
| 56522 | 5024 | PRKCI | protein kinase C, iota | HETSUB.1671C>T | 471R>C |
| 20448 | 622 | PTCH | patched homolog (Drosophila) | HETSUB.1764G>T | 526G>O |
| 43144 | 622 | PTCH | patched homolog (Drosophila) | HETSUB.1108C>T | 307T>I |
| 44713 | 622 | PTCH | patched homolog (Drosophila) | HETSUB.297G>C | 37G>R |
| 50060 | 622 | PTCH | patched homolog (Drosophila) | HETSUB.2553G>T | 789D>Y |
| 51702 | 622 | PTCH | patched homolog (Drosophila) | HETSUB.1790+1G>A | INTRONIC |
| 52327 | 622 | PTCH | patched homolog (Drosophila) | HETSUB.3382T>G | 1065V>G |
| 55494 | 622 | PTCH | patched homolog (Drosophila) | HETSUB.1099G>A | 304C>Y |
| 55557 | 622 | PTCH | patched homolog (Drosophila) | HETSUB.785G>T | 199L>F |
| 55861 | 622 | PTCH | patched homolog (Drosophila) | HETSUB.1062A>T | 292M>L |
| 56116 | 622 | PTCH | patched homolog (Drosophila) | HETSUB.801A>T | 205K>O |
| 57936 | 622 | PTCH | patched homolog (Drosophila) | HETSUB.285C>G | 33R>G |
| 66641 | 622 | PTCH | patched homolog (Drosophila) | HETSUB.4448T>A | 1420C>O |
| 66842 | 622 | PTCH | patched homolog (Drosophila) | HETSUB.4269G>A | 1361V>M |

FIGURE 1 (CONTINUED)

| | | | | | |
|---|---|---|---|---|---|
| 38084 | 2113 | 393189 | PTEN | phosphatase and tensin homolog (mutated in multiple advanced cancers 1) | HETDEL.1828A> | 266>FS |
| 39546 | 2113 | 393189 | PTEN | phosphatase and tensin homolog (mutated in multiple advanced cancers 1) | HETDEL.1539A> | 170>FS |
| 50580 | 2113 | 393189 | PTEN | phosphatase and tensin homolog (mutated in multiple advanced cancers 1) | HETSUB.1725C>T | 232R>O |
| 50700 | 2113 | 393189 | PTEN | phosphatase and tensin homolog (mutated in multiple advanced cancers 1) | HETSUB.1115T>G | 28I>M |
| 50703 | 2113 | 393189 | PTEN | phosphatase and tensin homolog (mutated in multiple advanced cancers 1) | HETSUB.1122A>C | 31N>H |
| 52999 | 2113 | 393189 | PTEN | phosphatase and tensin homolog (mutated in multiple advanced cancers 1) | HETSUB.1039C>A | 3A>D |
| 55476 | 2113 | 393189 | PTEN | phosphatase and tensin homolog (mutated in multiple advanced cancers 1) | HETSUB.1207C>T | 59S>L |
| 60284 | 2113 | 393189 | PTEN | phosphatase and tensin homolog (mutated in multiple advanced cancers 1) | HETSUB.1240+1G>A | INTRONIC |
| 62314 | 2113 | 393189 | PTEN | phosphatase and tensin homolog (mutated in multiple advanced cancers 1) | HETSUB.1809C>T | 260Q>O |
| 66596 | 2113 | 393189 | PTEN | phosphatase and tensin homolog (mutated in multiple advanced cancers 1) | HETDEL.1130TGCTATGGG> | 33IAMG>I |

FIGURE 1 (CONTINUED)

| | | | | | |
|---|---|---|---|---|---|
| 66602 | 2113 | 393189 | PTEN | phosphatase and tensin homolog (mutated in multiple advanced cancers 1) | HETSUB.2036C>A | 335Y>O |
| 66608 | 2113 | 393189 | PTEN | phosphatase and tensin homolog (mutated in multiple advanced cancers 1) | HETSUB.2030C>T | 333N>N |
| 66611 | 2113 | 393189 | PTEN | phosphatase and tensin homolog (mutated in multiple advanced cancers 1) | HETSUB.1976A>G | 315L>L |
| 4353 | 2172 | 226395 | RB1 | retinoblastoma 1 (including osteosarcoma) | HETSUB.308T>G | 57F>C |
| 4377 | 2172 | 226395 | RB1 | retinoblastoma 1 (including osteosarcoma) | HETSUB.2658+1G>A | INTRONIC |
| 16796 | 2172 | 226395 | RB1 | retinoblastoma 1 (including osteosarcoma) | HETSUB.1834-1G>A | INTRONIC |
| 39300 | 18517 | 518966 | Rem2 | | HOMDEL.374AGCCCCT GCTCA> | 96AAPAQ>A |
| 39768 | 18517 | 518966 | Rem2 | | HETDEL.374AGCCCCTG CTC> | 96>FS |
| 49348 | 1020 | 513223 | RET | ret proto-oncogene (multiple endocrine neoplasia and medullary thyroid carcinoma 1, Hirschsprung disease) | HETSUB.1753C>T | 525R>W |
| 49808 | 1020 | 513223 | RET | ret proto-oncogene (multiple endocrine neoplasia and medullary thyroid carcinoma 1, Hirschsprung disease) | HETSUB.2122G>A | 648V>I |
| 50366 | 1020 | 513223 | RET | ret proto-oncogene (multiple endocrine neoplasia and medullary thyroid carcinoma 1, Hirschsprung disease) | HETSUB.3056G>A | 959R>Q |

FIGURE 1 (CONTINUED)

| | | | | |
|---|---|---|---|---|
| 53324 | 1020 | 513223 | RET | ret proto-oncogene (multiple endocrine neoplasia and medullary thyroid carcinoma 1, Hirschsprung disease) | HETSUB.2461A>T | 761K>O |
| 57074 | 1020 | 513223 | RET | ret proto-oncogene (multiple endocrine neoplasia and medullary thyroid carcinoma 1, Hirschsprung disease) | HETSUB.2864T>C | 895L>S |
| 57972 | 1020 | 513223 | RET | ret proto-oncogene (multiple endocrine neoplasia and medullary thyroid carcinoma 1, Hirschsprung disease) | HETSUB.1874G>T | 565C>F |
| 59035 | 1020 | 513223 | RET | ret proto-oncogene (multiple endocrine neoplasia and medullary thyroid carcinoma 1, Hirschsprung disease) | HETSUB.2969C>T | 930T>M |
| 61201 | 1020 | 513223 | RET | ret proto-oncogene (multiple endocrine neoplasia and medullary thyroid carcinoma 1, Hirschsprung disease) | HETSUB.1823G>A | 548G>D |
| 62750 | 1020 | 513223 | RET | ret proto-oncogene (multiple endocrine neoplasia and medullary thyroid carcinoma 1, Hirschsprung disease) | HETSUB.2007C>A | 609C>O |
| 63699 | 1020 | 513223 | RET | ret proto-oncogene (multiple endocrine neoplasia and medullary thyroid carcinoma 1, Hirschsprung disease) | HETSUB.2522A>T | 781Q>L |
| 19605 | 1514 | 83169 | RON | macrophage stimulating 1 receptor (c-met-related tyrosine kinase) | HETSUB.3368A>T | 1114K>O |

FIGURE 1 (CONTINUED)

| | | | | |
|---|---|---|---|---|
| 50420 | 1514 | 83169 | RON | macrophage stimulating 1 receptor (c-met-related tyrosine kinase) | HETSUB.3771G>A | 1248R>H |
| 66566 | 1514 | 83169 | RON | macrophage stimulating 1 receptor (c-met-related tyrosine kinase) | HETDEL.2762G> | 912>FS |
| 56158 | 3359 | 513219 | SMAD2 | SMAD, mothers against DPP homolog 2 (Drosophila) | HETSUB.1627C>T | 460S>L |
| 20571 | 10842 | 396295 | Stk6 | serine/threonine kinase 6 | HETSUB.1004G>T | 216G>O |
| 43237 | 650 | 144601 | SUFU | suppressor of fused homolog (Drosophila) | HETSUB.452C>T | 102N>X |
| 57071 | 650 | 144601 | SUFU | suppressor of fused homolog (Drosophila) | HETSUB.501G>C | 119E>Q |
| 57110 | 650 | 144601 | SUFU | suppressor of fused homolog (Drosophila) | HETSUB.1245G>A | 367E>K |
| 34775 | 918 | 225645 | TGFBR1 | transforming growth factor, beta receptor I (activin A receptor type II-like kinase, 53kDa) | HETSUB.1274G>A | 400D>N |
| 48340 | 918 | 225645 | TGFBR1 | transforming growth factor, beta receptor I (activin A receptor type II-like kinase, 53kDa) | HETSUB.782T>C | 236S>P |
| 48535 | 1362 | 88656 | TGFBR2 | transforming growth factor, beta receptor II (70/80kDa) | HETDEL.718A> | 128>FS |
| 1828 | 2060 | 226297 | TP53 | tumor protein p53 (Li-Fraumeni syndrome) | HETSUB.1171-1G>T | INTRONIC |
| 4480 | 2060 | 226297 | TP53 | tumor protein p53 (Li-Fraumeni syndrome) | HETSUB.861G>T | 204E>O |
| 6188 | 2060 | 226297 | TP53 | tumor protein p53 (Li-Fraumeni syndrome) | HETSUB.923G>T | 224E>D |
| 6593 | 2060 | 226297 | TP53 | tumor protein p53 (Li-Fraumeni syndrome) | HETSUB.786C>T | 179H>Y |

FIGURE 1 (CONTINUED)

| | | | | | |
|---|---|---|---|---|---|
| 6605 | 2060 | 226297 | TP53 | tumor protein p53 (Li-Fraumeni syndrome) | HETSUB.631C>A | 127S>Y |
| 9510 | 2060 | 226297 | TP53 | tumor protein p53 (Li-Fraumeni syndrome) | HETSUB.348-2A>G | INTRONIC |
| 21243 | 2060 | 226297 | TP53 | tumor protein p53 (Li-Fraumeni syndrome) | HETSUB.1047G>T | 266G>O |
| 21252 | 2060 | 226297 | TP53 | tumor protein p53 (Li-Fraumeni syndrome) | HETSUB.1093A>T | 281D>V |
| 22224 | 2060 | 226297 | TP53 | tumor protein p53 (Li-Fraumeni syndrome) | HETSUB.1171-2A>G | INTRONIC |
| 34021 | 2060 | 226297 | TP53 | tumor protein p53 (Li-Fraumeni syndrome) | HETSUB.627-2A>G | INTRONIC |
| 34054 | 2060 | 226297 | TP53 | tumor protein p53 (Li-Fraumeni syndrome) | HETSUB.646A>T | 132K>M |
| 34078 | 2060 | 226297 | TP53 | tumor protein p53 (Li-Fraumeni syndrome) | HETSUB.825C>T | 192Q>O |
| 34081 | 2060 | 226297 | TP53 | tumor protein p53 (Li-Fraumeni syndrome) | HETSUB.841T>A | 197V>E |
| 34123 | 2060 | 226297 | TP53 | tumor protein p53 (Li-Fraumeni syndrome) | HETSUB.923+1G>T | INTRONIC |
| 40894 | 2060 | 226297 | TP53 | tumor protein p53 (Li-Fraumeni syndrome) | HETINS.899G>GGG | 217V>FS |
| 40900 | 2060 | 226297 | TP53 | tumor protein p53 (Li-Fraumeni syndrome) | HETDEL.913AGCCGCCT> | 221>FS |
| 40915 | 2060 | 226297 | TP53 | tumor protein p53 (Li-Fraumeni syndrome) | HETINS.1030C>CCC | 260S>FS |
| 40942 | 2060 | 226297 | TP53 | tumor protein p53 (Li-Fraumeni syndrome) | HETDEL.1111A> | 287>FS |
| 40954 | 2060 | 226297 | TP53 | tumor protein p53 (Li-Fraumeni syndrome) | HETDEL.1178C> | 309>FS |

FIGURE 1 (CONTINUED)

| | | | | | |
|---|---|---|---|---|---|
| 40966 | 2060 | 226297 | TP53 | tumor protein p53 (Li-Fraumeni syndrome) | HETDEL.1294T> | 348>FS |
| 40981 | 2060 | 226297 | TP53 | tumor protein p53 (Li-Fraumeni syndrome) | HETDEL.538C> | 96>FS |
| 40990 | 2060 | 226297 | TP53 | tumor protein p53 (Li-Fraumeni syndrome) | HETINS.621T>TTG | 124C>FS |
| 41023 | 2060 | 226297 | TP53 | tumor protein p53 (Li-Fraumeni syndrome) | HETINS.707G>GGC | 153P>FS |
| 41047 | 2060 | 226297 | TP53 | tumor protein p53 (Li-Fraumeni syndrome) | HETDEL.497G> | 82>FS |
| 41059 | 2060 | 226297 | TP53 | tumor protein p53 (Li-Fraumeni syndrome) | HETINS.760C>CCG | 170T>FS |
| 65679 | 2060 | 226297 | TP53 | tumor protein p53 (Li-Fraumeni syndrome) | HETSUB.987A>G | 246M>V |
| 68057 | 2060 | 226297 | TP53 | tumor protein p53 (Li-Fraumeni syndrome) | HETSUB.569C>G | 106S>R |
| 44439 | 18339 | 345840 | USP21 | ubiquitin specific protease 21 | HETSUB.1187G>A | 154R>H |
| 47472 | 18339 | 345840 | USP21 | ubiquitin specific protease 21 | HETSUB.1508G>A | 261R>Q |
| 52917 | 18339 | 345840 | USP21 | ubiquitin specific protease 21 | HETSUB.1234C>T | 170R>O |
| 57318 | 18339 | 345840 | USP21 | ubiquitin specific protease 21 | HETSUB.1744C>T | 340R>W |
| 64414 | 18339 | 345840 | USP21 | ubiquitin specific protease 21 | HETSUB.835-2A>G | INTRONIC |
| 45826 | 11424 | 547924 | USP24 | ubiquitin specific protease 24 | HETSUB.4991G>C | 1420L>F |
| 45763 | 17211 | 547823 | USP25 | ubiquitin specific protease 25 | HETSUB.610-2A>G | INTRONIC |
| 44782 | 17145 | 401357 | USP28 | ubiquitin specific protease 28 | HETSUB.928G>T | 310E>O |
| 47058 | 22165 | 373482 | USP35 | ubiquitin specific protease 35 | HETSUB.1087G>A | 178S>N |
| 51994 | 22165 | 373482 | USP35 | ubiquitin specific protease 35 | HETSUB.1737C>T | 395P>S |
| 61276 | 22165 | 373482 | USP35 | ubiquitin specific protease 35 | HETSUB.2572C>T | 673A>V |
| 62068 | 22165 | 373482 | USP35 | ubiquitin specific protease 35 | HETSUB.1495C>T | 314P>L |
| 16805 | 1025 | 188418 | VEGFR2 | kinase insert domain receptor (a type III receptor tyrosine kinase) | HETSUB.3205A>T | 968S>C |

FIGURE 1 (CONTINUED)

| | | | | | |
|---|---|---|---|---|---|
| 33675 | 1025 | 188418 | VEGFR2 | kinase insert domain receptor (a type III receptor tyrosine kinase) | HETSUB.2615C>T | 771T>M |
| 34093 | 1025 | 188418 | VEGFR2 | kinase insert domain receptor (a type III receptor tyrosine kinase) | HETSUB.2681A>G | 793N>S |
| 39732 | 1025 | 188418 | VEGFR2 | kinase insert domain receptor (a type III receptor tyrosine kinase) | HETSUB.3496G>C | 1065A>P |
| 47112 | 1025 | 188418 | VEGFR2 | kinase insert domain receptor (a type III receptor tyrosine kinase) | HETSUB.3877C>T | 1192L>F |
| 55762 | 1025 | 188418 | VEGFR2 | kinase insert domain receptor (a type III receptor tyrosine kinase) | HETSUB.2749C>T | 816H>Y |
| 59032 | 1025 | 188418 | VEGFR2 | kinase insert domain receptor (a type III receptor tyrosine kinase) | HETSUB.2635T>G | 778F>V |
| 60047 | 1025 | 188418 | VEGFR2 | kinase insert domain receptor (a type III receptor tyrosine kinase) | HETSUB.2838T>G | 845F>L |

FIGURE 2

| VARIANT ID | GENE | EFFECT | LOCATION | DOMAIN | TISSUE | TUMOR TYPE |
|---|---|---|---|---|---|---|
| 1049 | AKT-1 | Nonsyn. | Coding | Pkinase, Pkinase_Tyr | Breast | Breast Cancer, Non-matched normal |
| 11228 | AKT-1 | Nonsyn. | Coding | PH | Colon | Colorectal Cancer |
| 34129 | AKT-1 | Nonsyn. | Coding | Pkinase, Pkinase_Tyr | Lung | Non-Small Cell Lung Cancer |
| 48337 | AKT-1 | Nonsyn. | Coding | Pkinase, Pkinase_Tyr | Breast, Colon | Breast Cancer, Colorectal Cancer |
| 21270 | AKT2 | Nonsyn. | Coding | PH | Lung | Non-Small Cell Lung Cancer |
| 24683 | AKT2 | Nonsyn. | Coding | PH | Lung | Non-Small Cell Lung Cancer |
| 48080 | ALK | Nonsyn. | Coding | MAM | Colon | Colorectal Cancer |
| 52468 | ALK | Nonsyn. | Coding | MAM | Colon | Colorectal Cancer |
| 52471 | ALK | Nonsyn. | Coding |  | Colon | Colorectal Cancer |
| 62942 | ALK | Nonsyn. | Coding | MAM | Cecum | Colorectal Cancer |
| 1744 | ARAF | Nonsyn. | Coding | Pkinase, Pkinase_Tyr | Lung | Small Cell Lung Cancer |
| 1825 | ARAF | Nonsyn. | Coding | Pkinase, Pkinase_Tyr | Lung | Small Cell Lung Cancer |
| 21222 | ARAF | Nonsyn. | Coding | Pkinase, Pkinase_Tyr | Lung | Non-Small Cell Lung Cancer |
| 39239 | ARAF | Nonsyn. | Coding | Pkinase, Pkinase_Tyr | Lung | Normal |
| 42019 | AXIN1 | Nonsense | Coding |  | Liver | Hepatocellular Carcinoma |
| 47109 | AXIN1 | Nonsyn. | Coding |  | Colon | Colorectal Cancer |
| 47753 | AXIN1 | Nonsyn. | Coding |  | Colon | Colorectal Cancer |
| 57801 | AXIN1 | Nonsyn. | Coding |  | Stomach | Gastric Cancer |
| 61414 | AXIN1 | Nonsyn. | Coding | DIX | Lung | Non-Small Cell Lung Cancer |
| 47301 | AXIN2 | Nonsyn. | Coding | DIX | Colon | Colorectal Cancer |
| 47604 | AXIN2 | Nonsyn. | Coding | RGS | Colon | Colorectal Cancer |
| 58101 | AXIN2 | Nonsyn. | Coding |  | Lung | Non-Small Cell Lung Cancer |
| 58308 | AXIN2 | Nonsyn. | Coding | DIX | Stomach | Gastric Cancer |

FIGURE 2 (CONTINUED)

| | | | | |
|---|---|---|---|---|
| 62903 | AXIN2 | Nonsyn. | Coding | RGS | Lung | Non-Small Cell Lung Cancer |
| 47966 | AXL | Nonsyn. | Coding | Pkinase_Tyr, Pkinase | Colon | Colorectal Cancer |
| 48190 | AXL | Nonsense | Coding | Pkinase_Tyr, Pkinase | Colon Ascending | Colorectal Cancer |
| 63193 | BAX | Nonsyn. | Coding | | Kidney | Renal Cell Carcinoma |
| 19629 | BCL-XL | Nonsyn. | Coding | | Lung | Non-Small Cell Lung Cancer |
| 50324 | B-raf | Nonsyn. | Coding | Pkinase, Pkinase_Tyr | Colon Ascending | Colorectal Cancer |
| 53270 | B-raf | Nonsense | Coding | Pkinase, Pkinase_Tyr | Lung | Non-Small Cell Lung Cancer |
| 59665 | B-raf | Syn. | Coding | Pkinase, Pkinase_Tyr | Lung | Non-Small Cell Lung Cancer |
| 60390 | B-raf | Syn. | Coding | Pkinase, Pkinase_Tyr | Lung | Non-Small Cell Lung Cancer |
| 61456 | B-raf | Nonsyn. | Coding | Pkinase, Pkinase_Tyr | Stomach | Gastric Cancer |
| 3465 | CBL | | Splice Site | | Breast | Breast Cancer |
| 1188 | CBLB | Nonsyn. | Coding | | Lung | Non-Small Cell Lung Cancer |
| 60761 | CBLC | | Coding | | Breast, Lung, Ovary | Breast Cancer, Non-Small Cell Lung Cancer, Ovarian Cancer, Small Cell Lung Cancer |
| 20454 | CDKN2A | Nonsyn. | Coding | | Lung | Non-Small Cell Lung Cancer |
| 33648 | CDKN2A | Nonsyn. | Coding | | Lung | Non-Small Cell Lung Cancer |
| 40455 | CDKN2A | Nonsyn. | Coding | | Breast | Breast Cancer |
| 42941 | CDKN2A | Nonsyn. | Coding | | Liver | Hepatocellular Carcinoma |
| 60943 | CDKN2A | Nonsyn. | Coding | | Lung | Non-Small Cell Lung Cancer |
| 39399 | CIAS1 | Nonsyn. | Coding | | Lung | Small Cell Lung Cancer |
| 42354 | CIAS1 | Nonsyn. | Coding | | Lung | Small Cell Lung Cancer |
| 42552 | CIAS1 | Nonsyn. | Coding | | Lung | Small Cell Lung Cancer |
| 48256 | CIAS1 | Nonsyn. | Coding | NACHT | Colon | Colorectal Cancer |
| 56750 | CIAS1 | Nonsyn. | Coding | NACHT | Lung | Non-Small Cell Lung Cancer |

FIGURE 2 (CONTINUED)

| | | | | |
|---|---|---|---|---|
| 58209 | CIAS1 | Nonsense | Coding | | Lung | Non-Small Cell Lung Cancer |
| 58530 | CIAS1 | Nonsyn. | Coding | | Lung | Non-Small Cell Lung Cancer |
| 61627 | CIAS1 | Nonsyn. | Coding | NACHT | Lung | Non-Small Cell Lung Cancer |
| 61648 | CIAS1 | Nonsyn. | Coding | | Lung | Non-Small Cell Lung Cancer |
| 61663 | CIAS1 | Nonsyn. | Coding | | Lung | Non-Small Cell Lung Cancer |
| 20439 | cMet | Nonsyn. | Coding | | Liver | Hepatocellular Carcinoma |
| 45237 | cMet | Nonsyn. | Coding | sema | Colon | Colorectal Cancer |
| 47993 | cMet | Nonsyn. | Coding | sema | Colon | Colorectal Cancer |
| 48958 | cMet | Nonsyn. | Coding | TIG | Colon | Colorectal Cancer |
| 49423 | cMet | Nonsense | Coding | TIG | Colon | Colorectal Cancer |
| 49952 | cMet | Nonsense | Coding | Pkinase_Tyr, Pkinase | | |
| 50550 | cMet | Nonsense | Coding | Pkinase_Tyr, Pkinase | Colon | Colorectal Cancer |
| 57867 | cMet | Nonsense | Coding | psi | Skin | Melanoma |
| 61708 | cMet | Nonsyn. | Coding | | Lung | Non-Small Cell Lung Cancer |
| 63708 | cMet | Nonsyn. | Coding | sema | Lung | Non-Small Cell Lung Cancer |
| 48913 | CXCR4 | Nonsyn. | Coding | 7tm_1 | Skin | Melanoma |
| 49180 | CXCR4 | Nonsyn. | Coding | | Colon | Colorectal Cancer |
| 42025 | DDR2 | Nonsyn. | Coding | Pkinase, Pkinase_Tyr | Stomach | Gastric Cancer |
| 43879 | DDR2 | Nonsyn. | Coding | F5_F8_type_C | Stomach | Gastric Cancer |
| 47978 | DDR2 | Nonsyn. | Coding | Pkinase, Pkinase_Tyr | Stomach | Gastric Cancer |
| 48035 | DDR2 | Nonsyn. | Coding | | Colon | Colorectal Cancer |
| 58143 | DDR2 | Nonsyn. | Coding | Pkinase, Pkinase_Tyr | Lung | Non-Small Cell Lung Cancer |
| 24752 | DUBA2 | Nonsyn. | Coding | OTU | Lung | Non-Small Cell Lung Cancer |
| 25271 | DUBA2 | Nonsyn. | Coding | OTU | Lung | Non-Small Cell Lung Cancer |
| 31451 | DUBA2 | Nonsyn. | Coding | | Lung | Non-Small Cell Lung Cancer |
| 32342 | DUBA2 | Nonsyn. | Coding | | Lung | Non-Small Cell Lung Cancer |

FIGURE 2 (CONTINUED)

| | | | | | |
|---|---|---|---|---|---|
| 60791 | DUBA2 | Nonsyn. | Coding | | Lung | Non-Small Cell Lung Cancer |
| 41814 | EDG1 | Nonsyn. | Coding | | Lung | Small Cell Lung Cancer |
| 47493 | EDG1 | Nonsyn. | Coding | 7tm_1 | Colon | Colorectal Cancer |
| 48130 | EGFL11 | Nonsyn. | Coding | 7tm_1 | Colon | Colorectal Cancer |
| 49336 | EGFL11 | Nonsyn. | Coding | EGF | Colon | Colorectal Cancer |
| 49363 | EGFL11 | | Splice Site | | Colon | Colorectal Cancer |
| 49432 | EGFL11 | Nonsyn. | Coding | | Colon | Colorectal Cancer |
| 57447 | EGFL11 | Nonsyn. | Coding | | Lung | Small Cell Lung Cancer |
| 57642 | EGFL11 | Nonsyn. | Coding | EGF | Lung | Non-Small Cell Lung Cancer |
| 57648 | EGFL11 | Nonsyn. | Coding | | Lung | Non-Small Cell Lung Cancer |
| 61381 | EGFL11 | Nonsyn. | Coding | | Lung | Non-Small Cell Lung Cancer |
| 503 | EGFR | Syn. | Coding | Furin-like | Lung, Ovary | Non-Small Cell Lung Cancer, Ovarian Cancer |
| 3561 | EGFR | | Coding | Pkinase_Tyr, Pkinase | Lung | Non-Small Cell Lung Cancer |
| 8278 | EGFR | Syn. | Coding | Furin-like | Liver, Lung | Hepatocellular Carcinoma, Non-Small Cell Lung Cancer |
| 18069 | EGFR | Nonsyn. | Coding | Pkinase_Tyr, Pkinase | Lung | Non-Small Cell Lung Cancer |
| 22617 | EGFR | Nonsyn. | Coding | | Lung | Non-Small Cell Lung Cancer |
| 25259 | EGFR | Nonsyn. | Coding | | Lung | Non-Small Cell Lung Cancer |
| 39041 | EGFR | | Coding | Pkinase_Tyr, Pkinase | Lung | Non-Small Cell Lung Cancer |
| 39042 | EGFR | | Coding | Pkinase_Tyr, Pkinase | Lung | Non-Small Cell Lung Cancer |
| 41329 | EGFR | Nonsyn. | Coding | Recep_L_domain | Liver | Hepatocellular Carcinoma |
| 43418 | EGFR | Nonsyn. | Coding | Recep_L_domain | Skin | Melanoma |
| 45939 | EGFR | Nonsyn. | Coding | Recep_L_domain | Colon | Colorectal Cancer |
| 46170 | EGFR | Nonsyn. | Coding | | Colon | Colorectal Cancer |
| 46653 | EGFR | Syn. | Coding | | Colon | Colorectal Cancer |

FIGURE 2 (CONTINUED)

| | | | | | |
|---|---|---|---|---|---|
| 46815 | EGFR | Nonsyn. | Coding | Furin-like | Colon | Colorectal Cancer |
| 48406 | EGFR | Nonsyn. | Coding | Pkinase_Tyr, Pkinase | Lung | Non-Small Cell Lung Cancer |
| 48769 | EGFR | Nonsyn. | Coding | Recep_L_domain | Colon | Colorectal Cancer |
| 48832 | EGFR | Nonsyn. | Coding | Recep_L_domain | Colon | Colorectal Cancer |
| 54515 | EGFR | Nonsyn. | Coding | Furin-like | Lung | Non-Small Cell Lung Cancer |
| 56867 | EGFR | Syn. | Coding | Pkinase_Tyr, Pkinase | Stomach | Gastric Cancer |
| 56978 | EGFR | Syn. | Coding | Furin-like | Kidney | Renal Cell Carcinoma |
| 62480 | EGFR | Nonsyn. | Coding | Pkinase_Tyr, Pkinase | Lung | Non-Small Cell Lung Cancer |
| 68160 | EGFR | | Coding | Pkinase_Tyr, Pkinase | Lung | Non-Small Cell Lung Cancer |
| 71325 | EGFR | | Coding | Pkinase_Tyr, Pkinase | Lung | Non-Small Cell Lung Cancer |
| 14413 | ERBB3 | Nonsyn. | Coding | Recep_L_domain | Colon | Colorectal Cancer |
| 21276 | ERBB3 | Nonsyn. | Coding | Pkinase_Tyr, Pkinase | Lung | Non-Small Cell Lung Cancer |
| 43376 | ERBB3 | Syn. | Coding | | Ovary | Ovarian Cancer |
| 46092 | ERBB3 | Nonsyn. | Coding | Furin-like | Colon | Colorectal Cancer |
| 46128 | ERBB3 | Nonsyn. | Coding | Furin-like | Colon, Rectum | Colorectal Cancer |
| 46155 | ERBB3 | Nonsyn. | Coding | Furin-like | Colon | Colorectal Cancer |
| 46722 | ERBB3 | Nonsense | Coding | Furin-like | Colon | Colorectal Cancer |
| 46737 | ERBB3 | Nonsyn. | Coding | Furin-like | Colon | Colorectal Cancer |
| 46818 | ERBB3 | Syn. | Coding | | Colon | Colorectal Cancer |
| 48772 | ERBB3 | Nonsyn. | Coding | Furin-like | Stomach | Gastric Cancer |
| 48823 | ERBB3 | Nonsyn. | Coding | | Colon | Colorectal Cancer |
| 48847 | ERBB3 | Nonsyn. | Coding | Recep_L_domain | Colon | Colorectal Cancer |
| 54581 | ERBB3 | Syn. | Coding | Recep_L_domain | Stomach | Gastric Cancer |
| 59575 | ERBB3 | Nonsyn. | Coding | | Lung | Non-Small Cell Lung Cancer |
| 62615 | ERBB3 | Nonsyn. | Coding | Furin-like | Stomach | Gastric Cancer |

FIGURE 2 (CONTINUED)

| | | | | | |
|---|---|---|---|---|---|
| 62669 | ERBB3 | Nonsyn. | Coding | Pkinase_Tyr, Pkinase | Stomach | Gastric Cancer |
| 63244 | ERBB3 | Nonsyn. | Coding | Pkinase_Tyr, Pkinase | Cecum | Colorectal Cancer |
| 518 | ERBB4 | Nonsyn. | Coding | Furin-like | Lung | Small Cell Lung Cancer |
| 998 | ERBB4 | Nonsyn. | Coding | Pkinase_Tyr, Pkinase | Lung | Small Cell Lung Cancer |
| 22644 | ERBB4 | Nonsyn. | Coding | | Lung | Non-Small Cell Lung Cancer |
| 22674 | ERBB4 | Nonsyn. | Coding | Recep_L_domain | Lung | Non-Small Cell Lung Cancer |
| 22677 | ERBB4 | Nonsyn. | Coding | Recep_L_domain | Lung | Non-Small Cell Lung Cancer |
| 23115 | ERBB4 | Syn. | Coding | | Esophagus | Esophageal Cancer |
| 41302 | ERBB4 | Nonsyn. | Coding | Recep_L_domain | Kidney | Renal Cell Carcinoma |
| 45987 | ERBB4 | Nonsyn. | Coding | | Colon | Colorectal Cancer |
| 46068 | ERBB4 | Nonsyn. | Coding | Recep_L_domain | Colon | Colorectal Cancer |
| 46215 | ERBB4 | Nonsyn. | Coding | Recep_L_domain | Colon | Colorectal Cancer |
| 46257 | ERBB4 | Nonsyn. | Coding | | Colon, Kidney, Lung, Ovary, Skin | Colorectal Cancer, Melanoma, Non-Small Cell Lung Cancer, Ovarian Cancer, Renal Cell Carcinoma |
| 46287 | ERBB4 | Nonsyn. | Coding | | Colon | Colorectal Cancer |
| 46581 | ERBB4 | Nonsyn. | Coding | | Stomach | Gastric Cancer |
| 46617 | ERBB4 | Nonsyn. | Coding | Pkinase_Tyr, Pkinase | Colon | Colorectal Cancer |
| 46686 | ERBB4 | Nonsyn. | Coding | | Colon | Colorectal Cancer |
| 46725 | ERBB4 | Nonsyn. | Coding | | Colon | Colorectal Cancer |
| 46773 | ERBB4 | Nonsyn. | Coding | | Colon | Colorectal Cancer |
| 46821 | ERBB4 | Nonsyn. | Coding | Recep_L_domain | Colon | Colorectal Cancer |
| 48430 | ERBB4 | Nonsyn. | Coding | Pkinase_Tyr, Pkinase | Lung | Non-Small Cell Lung Cancer |

FIGURE 2 (CONTINUED)

| | | | | |
|---|---|---|---|---|
| 48433 | ERBB4 | | Coding | Pkinase_Tyr, Pkinase | Lung | Non-Small Cell Lung Cancer |
| 48883 | ERBB4 | Nonsense | Coding | Pkinase_Tyr, Pkinase | Colon | Colorectal Cancer |
| 48889 | ERBB4 | Syn. | Coding | Pkinase_Tyr, Pkinase | Colon | Colorectal Cancer |
| 53759 | ERBB4 | Nonsyn. | Coding | Pkinase_Tyr | Skin | Melanoma |
| 53933 | ERBB4 | Nonsyn. | Coding | Recep_L_domain | Lung | Non-Small Cell Lung Cancer |
| 53936 | ERBB4 | Nonsyn. | Coding | Furin-like | Lung | Non-Small Cell Lung Cancer |
| 54383 | ERBB4 | Nonsyn. | Coding | | Skin | Melanoma |
| 54494 | ERBB4 | Nonsyn. | Coding | | Stomach | Gastric Cancer |
| 54527 | ERBB4 | Syn. | Coding | Furin-like | Lung | Non-Small Cell Lung Cancer |
| 54584 | ERBB4 | Syn. | Coding | | Skin | Melanoma |
| 56996 | ERBB4 | Nonsyn. | Coding | Pkinase_Tyr, Pkinase | Skin | Melanoma |
| 60368 | ERBB4 | Nonsyn. | Coding | | Lung | Non-Small Cell Lung Cancer |
| 62305 | ERBB4 | Syn. | Coding | Recep_L_domain | Lung | Non-Small Cell Lung Cancer |
| 62317 | ERBB4 | Nonsyn. | Coding | | Lung | Non-Small Cell Lung Cancer |
| 63370 | ERBB4 | Nonsyn. | Coding | | Cecum | Colorectal Cancer |
| 40143 | ETBR | | Coding | | Colon, Stomach | Colorectal Cancer, Gastric Cancer |
| 6736 | FGFR1 | Nonsyn. | Coding | | Kidney, Lung | Non-Small Cell Lung Cancer, Renal Cell Carcinoma |
| 51801 | FGFR1 | Nonsyn. | Coding | Pkinase_Tyr, Pkinase | Colon | Colorectal Cancer |
| 65700 | FGFR1 | | Coding | | Colon | Colorectal Cancer |
| 25094 | FGFR2 | Nonsyn. | Coding | Pkinase_Tyr, Pkinase | Lung | Non-Small Cell Lung Cancer |
| 25295 | FGFR2 | | Intronic | | Lung | Non-Small Cell Lung Cancer |
| 25298 | FGFR2 | | Intronic | | Lung | Non-Small Cell Lung Cancer |

FIGURE 2 (CONTINUED)

| | | | | | |
|---|---|---|---|---|---|
| 41110 | FGFR2 | Nonsyn. | Coding | Pkinase_Tyr, Pkinase | Breast | Breast Cancer |
| 51435 | FGFR2 | Nonsyn. | Coding | Pkinase_Tyr, Pkinase | Skin, Stomach | Gastric Cancer, Melanoma |
| 43654 | FGFR3 | Nonsyn. | Coding | I-set | Lung | Small Cell Lung Cancer |
| 59653 | FGFR3 | Nonsyn. | Coding | Pkinase_Tyr, Pkinase | Lung | Non-Small Cell Lung Cancer |
| 59726 | FGFR3 | Nonsyn. | Coding | Pkinase_Tyr, Pkinase | Stomach | Gastric Cancer |
| 66719 | FGFR3 | Nonsyn. | Coding | | Lung | Non-Small Cell Lung Cancer |
| 49258 | FGFR4 | | Splice Site | | Stomach | Gastric Cancer |
| 50030 | FGFR4 | Nonsyn. | Coding | Pkinase_Tyr, Pkinase | Colon | Colorectal Cancer |
| 35617 | FRAP1 | Syn. | Coding | PI3_PI4_kinase | Lung | Non-Small Cell Lung Cancer |
| 35620 | FRAP1 | Nonsyn. | Coding | PI3_PI4_kinase | Lung | Non-Small Cell Lung Cancer |
| 47061 | GPR73 | Nonsyn. | Coding | 7tm_1 | Colon | Colorectal Cancer |
| 47214 | GPR73 | Nonsyn. | Coding | 7tm_1 | Colon | Colorectal Cancer |
| 47550 | GPR73 | Nonsyn. | Coding | 7tm_1 | Colon, Stomach | Colorectal Cancer, Gastric Cancer |
| 48187 | GPR73 | Nonsyn. | Coding | 7tm_1 | Colon | Colorectal Cancer |
| 58254 | GPR73 | Nonsyn. | Coding | 7tm_1 | Ovary | Ovarian Cancer |
| 61498 | GPR73 | Nonsyn. | Coding | 7tm_1 | Stomach | Gastric Cancer |
| 8909 | Her2 | Nonsyn. | Coding | | Breast, Colon | Breast Cancer, Colorectal Cancer |
| 46206 | Her2 | Nonsyn. | Coding | Pkinase_Tyr, Pkinase | Colon | Colorectal Cancer |
| 46596 | Her2 | Nonsyn. | Coding | | Colon | Colorectal Cancer |
| 56924 | Her2 | Nonsyn. | Coding | Furin-like | Lung | Non-Small Cell Lung Cancer |
| 59047 | Her2 | Nonsyn. | Coding | | Lung | Non-Small Cell Lung Cancer |
| 64241 | Her2 | Nonsyn. | Coding | Pkinase_Tyr, Pkinase | Stomach | Gastric Cancer |

FIGURE 2 (CONTINUED)

| | | | | | |
|---|---|---|---|---|---|
| 16877 | IGF1-R | Nonsyn. | Coding | Pkinase_Tyr, Pkinase | Lung | Non-Small Cell Lung Cancer |
| 53381 | IGF1-R | Nonsyn. | Coding | Pkinase | Lung | Non-Small Cell Lung Cancer |
| 59230 | IGF1-R | Nonsyn. | Coding | | Lung | Non-Small Cell Lung Cancer |
| 66898 | JAG1 | Nonsyn. | Coding | | Stomach | Gastric Cancer |
| 63696 | JAG2 | Nonsyn. | Coding | MNNL | Stomach | Gastric Cancer |
| 42407 | JAK2 | Nonsyn. | Coding | Pkinase_Tyr, Pkinase | Ovary | Ovarian Cancer |
| 48119 | JAK2 | Nonsyn. | Coding | SH2 | Colon | Colorectal Cancer |
| 48226 | JAK2 | Nonsyn. | Coding | | Stomach | Gastric Cancer |
| 61840 | JAK2 | Nonsyn. | Coding | Pkinase_Tyr, Pkinase | Lung | Non-Small Cell Lung Cancer |
| 62456 | JAK2 | Nonsyn. | Coding | Pkinase_Tyr, Pkinase | Lung | Non-Small Cell Lung Cancer |
| 62735 | JAK2 | Nonsyn. | Coding | Pkinase_Tyr, Pkinase | Lung | Non-Small Cell Lung Cancer |
| 42835 | KRAS | Nonsyn. | Coding | Ras | Ovary | Ovarian Cancer |
| 56131 | MAP2K1 | Nonsyn. | Coding | Pkinase | Lung | Non-Small Cell Lung Cancer |
| 54898 | MELK | Nonsyn. | Coding | | Lung | Non-Small Cell Lung Cancer |
| 54916 | MELK | Nonsyn. | Coding | Pkinase, Pkinase_Tyr | Lung | Non-Small Cell Lung Cancer |
| 55173 | MELK | Nonsyn. | Coding | Pkinase, Pkinase_Tyr | Colon | Colorectal Cancer |
| 55383 | MELK | Nonsense | Coding | | Colon | Colorectal Cancer |
| 66421 | MELK | Nonsyn. | Coding | Pkinase, Pkinase_Tyr | Stomach | Gastric Cancer |
| 44002 | Notch2 | Nonsyn. | Coding | | Lung | Small Cell Lung Cancer |
| 47589 | Notch2 | Nonsyn. | Coding | | Colon | Colorectal Cancer |
| 52914 | Notch2 | Nonsyn. | Coding | | Colon | Colorectal Cancer |
| 63840 | Notch2 | Nonsyn. | Coding | | Kidney | Renal Cell Carcinoma |
| 47340 | NOTCH3 | Nonsyn. | Coding | | Colon | Colorectal Cancer |

FIGURE 2 (CONTINUED)

| | | | | | |
|---|---|---|---|---|---|
| 49231 | NOTCH3 | Nonsyn. | Coding | | Colon | Colorectal Cancer |
| 52510 | NOTCH3 | Nonsyn. | Coding | | Colon | Colorectal Cancer |
| 52902 | NOTCH3 | Nonsyn. | Coding | | Colon | Colorectal Cancer |
| 62513 | NOTCH3 | Nonsyn. | Coding | | Stomach | Gastric Cancer |
| 47322 | NRP1 | Nonsyn. | Coding | CUB | Colon | Colorectal Cancer |
| 47643 | NRP1 | Nonsyn. | Coding | MAM | Colon | Colorectal Cancer |
| 47900 | NRP1 | Nonsyn. | Coding | F5_F8_type_C | Colon | Colorectal Cancer |
| 48017 | NRP1 | Nonsyn. | Coding | MAM | Colon | Colorectal Cancer |
| 48026 | NRP1 | Nonsyn. | Coding | CUB | Colon | Colorectal Cancer |
| 48268 | NRP1 | Nonsense | Coding | CUB | Colon | Colorectal Cancer |
| 61336 | NRP1 | Nonsyn. | Coding | MAM | Lung | Non-Small Cell Lung Cancer |
| 63891 | NRP1 | Nonsyn. | Coding | CUB | Rectum | Colorectal Cancer |
| 66091 | NRP1 | Nonsyn. | Coding | F5_F8_type_C | Liver | Hepatocellular Carcinoma |
| 44988 | NTC1 | Nonsyn. | Coding | | Kidney | Renal Cell Carcinoma |
| 49114 | NTC1 | Nonsyn. | Coding | EGF | Stomach | Gastric Cancer |
| 57882 | NTC1 | Nonsyn. | Coding | | Ovary | Ovarian Cancer |
| 57918 | NTC1 | Nonsyn. | Coding | | Lung | Non-Small Cell Lung Cancer |
| 58713 | NTC1 | Nonsyn. | Coding | | Lung | Non-Small Cell Lung Cancer |
| 66106 | NTC1 | Nonsyn. | Coding | | Colon | Colorectal Cancer |
| 52351 | NTRK1 | Nonsyn. | Coding | Pkinase_Tyr, Pkinase | Colon | Colorectal Cancer |
| 52357 | NTRK1 | Nonsyn. | Coding | Pkinase_Tyr, Pkinase | Colon | Colorectal Cancer |
| 52908 | NTRK1 | Nonsyn. | Coding | | Colon | Colorectal Cancer |
| 52920 | NTRK1 | Nonsyn. | Coding | | Colon | Colorectal Cancer |
| 61207 | NTRK1 | Nonsyn. | Coding | Pkinase_Tyr, Pkinase | Lung | Non-Small Cell Lung Cancer |
| 61990 | NTRK1 | Nonsyn. | Coding | Pkinase_Tyr, Pkinase | Lung | Non-Small Cell Lung Cancer |
| 62729 | NTRK1 | Nonsyn. | Coding | Pkinase_Tyr, Pkinase | Lung | Non-Small Cell Lung Cancer |

FIGURE 2 (CONTINUED)

| | | | | |
|---|---|---|---|---|
| 58317 | NTRK2 | Nonsyn. | Coding | Pkinase_Tyr, Pkinase | Lung | Non-Small Cell Lung Cancer |
| 62561 | NTRK2 | Nonsyn. | Coding | Pkinase_Tyr, Pkinase | Lung | Non-Small Cell Lung Cancer |
| 62627 | NTRK2 | Nonsyn. | Coding | Pkinase_Tyr, Pkinase | Kidney | Renal Cell Carcinoma |
| 19623 | NTRK3 | Nonsense | Coding | Pkinase_Tyr, Pkinase | Lung | Non-Small Cell Lung Cancer |
| 19635 | NTRK3 | | Splice Site | | Lung | Non-Small Cell Lung Cancer |
| 42588 | NTRK3 | | Splice Site | | Skin | Melanoma |
| 42699 | NTRK3 | | Splice Site | | Skin | Melanoma |
| 42938 | NTRK3 | Nonsyn. | Coding | Pkinase_Tyr, Pkinase | Lung | Small Cell Lung Cancer |
| 46920 | NTRK3 | Nonsyn. | Coding | I-set | Colon | Colorectal Cancer |
| 48110 | NTRK3 | Nonsyn. | Coding | | Colon | Colorectal Cancer |
| 49517 | NTRK3 | Nonsyn. | Coding | Pkinase_Tyr, Pkinase | Colon | Colorectal Cancer |
| 51192 | NTRK3 | Nonsyn. | Coding | Pkinase_Tyr, Pkinase | Colon | Colorectal Cancer |
| 51450 | NTRK3 | Nonsyn. | Coding | | Colon | Colorectal Cancer |
| 56023 | NTRK3 | Nonsyn. | Coding | | Skin | Melanoma |
| 56795 | NTRK3 | Nonsyn. | Coding | | Lung | Non-Small Cell Lung Cancer |
| 57158 | NTRK3 | | Splice Site | | Lung | Non-Small Cell Lung Cancer |
| 58980 | NTRK3 | Nonsyn. | Coding | LRRNT | Lung | Non-Small Cell Lung Cancer |
| 60140 | NTRK3 | Nonsyn. | Coding | | Kidney | Renal Cell Carcinoma |
| 60311 | NTRK3 | Nonsyn. | Coding | | Lung | Non-Small Cell Lung Cancer |
| 62459 | NTRK3 | Nonsyn. | Coding | | Kidney | Renal Cell Carcinoma |
| 44095 | OTUD1 | Nonsyn. | Coding | | Lung | Small Cell Lung Cancer |
| 48113 | OTUD1 | Nonsyn. | Coding | | Colon | Colorectal Cancer |
| 49144 | OTUD1 | Nonsyn. | Coding | | Colon | Colorectal Cancer |
| 20093 | PAK6 | Nonsyn. | Coding | | Lung | Non-Small Cell Lung Cancer |

FIGURE 2 (CONTINUED)

| | | | | | |
|---|---|---|---|---|---|
| 50778 | PDGFRB | Nonsyn. | Coding | Pkinase_Tyr | Colon | Colorectal Cancer |
| 50916 | PDGFRB | Nonsyn. | Coding | Pkinase_Tyr, Pkinase | Colon | Colorectal Cancer |
| 55440 | PDGFRB | Nonsyn. | Coding | Pkinase_Tyr, Pkinase | Skin | Melanoma |
| 57266 | PDGFRB | Nonsyn. | Coding | Pkinase_Tyr, Pkinase | Lung | Small Cell Lung Cancer |
| 59089 | PDGFRB | | Splice Site | | Kidney | Renal Cell Carcinoma |
| 62978 | PDGFRB | Nonsyn. | Coding | Pkinase_Tyr, Pkinase | Kidney | Renal Cell Carcinoma |
| 32048 | PDK1 | | Splice Site | | Lung | Non-Small Cell Lung Cancer |
| 33706 | PDK1 | Nonsyn. | Coding | HATPase_c | Lung | Non-Small Cell Lung Cancer |
| 42747 | PIK3CA | Nonsyn. | Coding | PI3K_C2 | Breast | Breast Cancer |
| 50685 | PIK3CA | Nonsyn. | Coding | PI3Ka | Colon | Colorectal Cancer |
| 51456 | PIK3CA | Syn. | Coding | PI3_PI4_kinase | Colon | Colorectal Cancer |
| 51750 | PIK3CA | Nonsyn. | Coding | PI3_PI4_kinase | Colon | Colorectal Cancer |
| 51810 | PIK3CA | Nonsyn. | Coding | PI3K_p85B | Stomach | Gastric Cancer |
| 55527 | PIK3CA | Syn. | Coding | | Skin | Melanoma |
| 55858 | PIK3CA | Nonsyn. | Coding | PI3_PI4_kinase | Colon Sigmoid, Rectum | Colorectal Cancer |
| 63813 | PIK3CA | Nonsyn. | Coding | PI3_PI4_kinase | Lung | Non-Small Cell Lung Cancer |
| 66964 | PIK3CA | Nonsyn. | Coding | | Stomach | Gastric Cancer |
| 47187 | PIK3R1 | Nonsyn. | Coding | | Colon | Colorectal Cancer |
| 48068 | PIK3R1 | Nonsense | Coding | | Colon | Colorectal Cancer |
| 49877 | PIK3R1 | Nonsyn. | Coding | | Colon | Colorectal Cancer |
| 50039 | PIK3R1 | Nonsyn. | Coding | | Colon | Colorectal Cancer |
| 50042 | PIK3R1 | Nonsyn. | Coding | | Colon | Colorectal Cancer |
| 50486 | PIK3R1 | Nonsyn. | Coding | | Colon | Colorectal Cancer |
| 50694 | PIK3R1 | Nonsense | Coding | | Colon | Colorectal Cancer |
| 51309 | PIK3R1 | Nonsyn. | Coding | | Colon | Colorectal Cancer |
| 51612 | PIK3R1 | Nonsyn. | Coding | | Colon | Colorectal Cancer |

FIGURE 2 (CONTINUED)

| | | | | | |
|---|---|---|---|---|---|
| 52429 | PIK3R1 | Nonsense | Coding | | Colon | Colorectal Cancer |
| 56185 | PIK3R1 | Nonsyn. | Coding | | Pancreas | Pancreatic Cancer |
| 56188 | PIK3R1 | Nonsyn. | Coding | | Breast | Breast Cancer |
| 66584 | PIK3R1 | Nonsyn. | Coding | | Colon | Colorectal Cancer |
| 71322 | PIK3R1 | Nonsyn. | Coding | | Colon | Colorectal Cancer |
| 67250 | PIK3R2 | Nonsyn. | Coding | | Colon | Colorectal Cancer |
| 67382 | PIK3R4 | Nonsyn. | Coding | | Stomach | Gastric Cancer |
| 67451 | PIK3R4 | Nonsyn. | Coding | | Ovary | Ovarian Cancer |
| 67331 | PIK3R5 | Nonsyn. | Coding | | Stomach | Gastric Cancer |
| 34015 | PLK1 | Nonsyn. | Coding | | Lung | Non-Small Cell Lung Cancer |
| 46956 | PRKCB1 | Nonsyn. | Coding | | Colon | Colorectal Cancer |
| 47232 | PRKCB1 | Nonsyn. | Coding | | Skin | Melanoma |
| 47421 | PRKCB1 | Nonsyn. | Coding | Pkinase_C | Colon | Colorectal Cancer |
| 47652 | PRKCB1 | Nonsyn. | Coding | C1_1 | Skin | Melanoma |
| 48092 | PRKCB1 | Nonsyn. | Coding | Pkinase, Pkinase_Tyr | Colon | Colorectal Cancer |
| 48259 | PRKCB1 | Nonsyn. | Coding | | Colon | Colorectal Cancer |
| 61462 | PRKCB1 | Nonsyn. | Coding | Pkinase, Pkinase_Tyr | Lung | Non-Small Cell Lung Cancer |
| 55155 | PRKCI | Nonsyn. | Coding | Pkinase, Pkinase_Tyr | Stomach | Gastric Cancer |
| 55401 | PRKCI | Nonsyn. | Coding | Pkinase, Pkinase_Tyr | Colon | Colorectal Cancer |
| 55410 | PRKCI | Nonsyn. | Coding | C1_1 | Colon | Colorectal Cancer |
| 56522 | PRKCI | Nonsyn. | Coding | Pkinase, Pkinase_Tyr | Ovary | Ovarian Cancer |
| 20448 | PTCH | Nonsense | Coding | Patched | Lung | Non-Small Cell Lung Cancer |
| 43144 | PTCH | Nonsyn. | Coding | | Ovary | Ovarian Cancer |
| 44713 | PTCH | Nonsyn. | Coding | | Breast, Lung | Breast Cancer, Non-Small Cell Lung Cancer |
| 50060 | PTCH | Nonsyn. | Coding | | Colon | Colorectal Cancer |

FIGURE 2 (CONTINUED)

| | | | | | |
|---|---|---|---|---|---|
| 51702 | PTCH | | Splice Site | Colon | Colorectal Cancer |
| 52327 | PTCH | Nonsyn. | Coding | Colon | Colorectal Cancer |
| 55494 | PTCH | Nonsyn. | Coding | Ovary | Ovarian Cancer |
| 55557 | PTCH | Nonsyn. | Coding | Liver | Hepatocellular Carcinoma |
| 55861 | PTCH | Nonsyn. | Coding | Lung | Non-Small Cell Lung Cancer |
| 56116 | PTCH | Nonsense | Coding | Lung | Non-Small Cell Lung Cancer |
| 57936 | PTCH | Nonsyn. | Coding | Stomach | Gastric Cancer |
| 66641 | PTCH | Nonsense | Coding | Skin | Melanoma |
| 66842 | PTCH | Nonsyn. | Coding | Colon | Colorectal Cancer |
| 38084 | PTEN | | Coding | Lung | Non-Small Cell Lung Cancer |
| 39546 | PTEN | | Coding | Lung | Non-Small Cell Lung Cancer |
| 50580 | PTEN | Nonsense | Coding | Colon | Colorectal Cancer |
| 50700 | PTEN | Nonsyn. | Coding | Colon | Colorectal Cancer |
| 50703 | PTEN | Nonsyn. | Coding | Colon | Colorectal Cancer |
| 52999 | PTEN | Nonsyn. | Coding | Colon | Colorectal Cancer |
| 55476 | PTEN | Nonsyn. | Coding | Lung | Non-Small Cell Lung Cancer |
| 60284 | PTEN | | Splice Site | Stomach | Gastric Cancer |
| 62314 | PTEN | Nonsense | Coding | Skin | Melanoma |
| 66596 | PTEN | | Coding | Stomach | Gastric Cancer |
| 66602 | PTEN | Nonsense | Coding | Colon | Colorectal Cancer |
| 66608 | PTEN | Syn. | Coding | Skin | Melanoma |
| 66611 | PTEN | Syn. | Coding | Skin | Melanoma |
| 4353 | RB1 | Nonsyn. | Coding | Lung | Non-Small Cell Lung Cancer |
| 4377 | RB1 | | Splice Site | Lung | Non-Small Cell Lung Cancer |
| 16796 | RB1 | | Splice Site | Lung | Non-Small Cell Lung Cancer |
| 39300 | Rem2 | | Coding | Lung | Non-Small Cell Lung Cancer |
| 39768 | Rem2 | | Coding | Lung | Non-Small Cell Lung Cancer |
| 49348 | RET | Nonsyn. | Coding | Colon | Colorectal Cancer |
| 49808 | RET | Nonsyn. | Coding | Colon | Colorectal Cancer |
| 50366 | RET | Nonsyn. | Coding | Colon | Colorectal Cancer |

Annotations (right side, additional columns): row 51702 "Patched"; row 50366 "Pkinase_Tyr, Pkinase".

FIGURE 2 (CONTINUED)

| | | | | |
|---|---|---|---|---|
| 53324 | RET | Nonsense | Coding | Pkinase_Tyr, Pkinase | Lung | Non-Small Cell Lung Cancer |
| 57074 | RET | Nonsyn. | Coding | Pkinase_Tyr, Pkinase | Lung | Non-Small Cell Lung Cancer |
| 57972 | RET | Nonsyn. | Coding | Pkinase_Tyr, Pkinase | Lung | Small Cell Lung Cancer |
| 59035 | RET | Nonsyn. | Coding | Pkinase | Stomach | Gastric Cancer |
| 61201 | RET | Nonsyn. | Coding | Pkinase_Tyr, Pkinase | Ovary | Ovarian Cancer |
| 62750 | RET | Nonsense | Coding | | Lung | Non-Small Cell Lung Cancer |
| 63699 | RET | Nonsyn. | Coding | Pkinase_Tyr, Pkinase | Lung | Non-Small Cell Lung Cancer |
| 19605 | RON | Nonsense | Coding | Pkinase_Tyr, Pkinase | Lung | Non-Small Cell Lung Cancer |
| 50420 | RON | Nonsyn. | Coding | Pkinase_Tyr, Pkinase | Colon | Colorectal Cancer |
| 66566 | RON | Nonsyn. | Coding | | Colon | Colorectal Cancer |
| 56158 | SMAD2 | Nonsense | Coding | Pkinase, Pkinase_Tyr | Lung | Non-Small Cell Lung Cancer |
| 20571 | Stk6 | Nonsense | Coding | | Lung | Non-Small Cell Lung Cancer |
| 43237 | SUFU | Nonsyn. | Coding | SUFU | Colon, Skin | Colorectal Cancer, Melanoma |
| 57071 | SUFU | Nonsyn. | Coding | SUFU | Stomach | Gastric Cancer |
| 57110 | SUFU | Nonsyn. | Coding | SUFU | Lung | Non-Small Cell Lung Cancer |
| 34775 | TGFBR1 | Nonsyn. | Coding | Pkinase | Lung | Non-Small Cell Lung Cancer |
| 48340 | TGFBR1 | Nonsyn. | Coding | Pkinase, Pkinase_Tyr | Lung | Non-Small Cell Lung Cancer |

FIGURE 2 (CONTINUED)

| ID | Gene | Mutation | Region | Marker | Tissue | Cancer |
|---|---|---|---|---|---|---|
| 48535 | TGFBR2 | | Coding | | Breast, Colon, Kidney, Lung, Lymph Node, Ovary, Urinary Bladder | Bladder Cancer, Breast Cancer, Colorectal Cancer, Non-Small Cell Lung Cancer, Ovarian Cancer, Renal Cell Carcinoma, Small Cell Lung Cancer |
| 1828 | TP53 | | Splice Site | | Lung | Non-Small Cell Lung Cancer |
| 4480 | TP53 | Nonsense | Coding | P53 | Breast, Ovary | Breast Cancer, Ovarian Cancer |
| 6188 | TP53 | Nonsyn. | Coding | P53 | Lung | Non-Small Cell Lung Cancer |
| 6593 | TP53 | Nonsyn. | Coding | P53 | Breast, Lung | Breast Cancer, Non-Small Cell Lung Cancer |
| 6605 | TP53 | Nonsyn. | Coding | P53 | Breast | Breast Cancer |
| 9510 | TP53 | | Splice Site | | Lung | Non-Small Cell Lung Cancer |
| 21243 | TP53 | Nonsense | Coding | P53 | Lung | Non-Small Cell Lung Cancer |
| 21252 | TP53 | Nonsyn. | Coding | P53 | Lung | Non-Small Cell Lung Cancer |
| 22224 | TP53 | | Splice Site | | Lung | Non-Small Cell Lung Cancer |
| 34021 | TP53 | | Splice Site | | Lung | Non-Small Cell Lung Cancer |
| 34054 | TP53 | Nonsyn. | Coding | P53 | Lung | Non-Small Cell Lung Cancer |
| 34078 | TP53 | Nonsense | Coding | P53 | Lung | Non-Small Cell Lung Cancer |
| 34081 | TP53 | Nonsyn. | Coding | P53 | Lung | Non-Small Cell Lung Cancer |
| 34123 | TP53 | | Splice Site | | Lung | Non-Small Cell Lung Cancer |
| 40894 | TP53 | | Coding | P53 | Breast | Breast Cancer |
| 40900 | TP53 | | Coding | P53 | Lung | Non-Small Cell Lung Cancer |
| 40915 | TP53 | | Coding | P53 | Lung | Non-Small Cell Lung Cancer |
| 40942 | TP53 | | Coding | P53 | Lung | Non-Small Cell Lung Cancer |
| 40954 | TP53 | | Coding | P53 | Lung | Non-Small Cell Lung Cancer |
| 40966 | TP53 | | Coding | P53_tetramer | Lung | Non-Small Cell Lung Cancer |
| 40981 | TP53 | | Coding | P53 | Breast | Breast Cancer |
| 40990 | TP53 | | Coding | P53 | Breast | Breast Cancer |
| 41023 | TP53 | | Coding | P53 | Breast | Breast Cancer |

FIGURE 2 (CONTINUED)

| | | | | | |
|---|---|---|---|---|---|
| 41047 | TP53 | | Coding | | Lung | Non-Small Cell Lung Cancer |
| 41059 | TP53 | | Coding | | Lung | Non-Small Cell Lung Cancer |
| 65679 | TP53 | Nonsyn. | Coding | P53 | Lung | Non-Small Cell Lung Cancer |
| 68057 | TP53 | Nonsyn. | Coding | P53 | Lung | Small Cell Lung Cancer |
| 44439 | USP21 | Nonsyn. | Coding | P53 | Lung | Small Cell Lung Cancer |
| 47472 | USP21 | Nonsyn. | Coding | UCH | Colon | Colorectal Cancer |
| 52917 | USP21 | Nonsense | Coding | UCH | Colon | Colorectal Cancer |
| 57318 | USP21 | Nonsyn. | Coding | UCH | Kidney | Renal Cell Carcinoma |
| 64414 | USP21 | | Splice Site | UCH | Cecum | Colorectal Cancer |
| 45826 | USP24 | Nonsyn. | Coding | | Lung | Non-Small Cell Lung Cancer |
| 45763 | USP25 | | Splice Site | | Lung | Non-Small Cell Lung Cancer |
| 44782 | USP28 | Nonsense | Coding | UCH | Lung | Non-Small Cell Lung Cancer |
| 47058 | USP35 | Nonsyn. | Coding | | Colon | Colorectal Cancer |
| 51994 | USP35 | Nonsyn. | Coding | UCH | Pancreas | Pancreatic Cancer |
| 61276 | USP35 | Nonsyn. | Coding | UCH | Kidney | Renal Cell Carcinoma |
| 62068 | USP35 | Nonsyn. | Coding | UCH | Stomach | Gastric Cancer |
| 16805 | VEGFR2 | Nonsyn. | Coding | Pkinase_Tyr | Lung | Non-Small Cell Lung Cancer |
| 33675 | VEGFR2 | Nonsyn. | Coding | | Kidney, Lung | Non-Small Cell Lung Cancer, Renal Cell Carcinoma |
| 34093 | VEGFR2 | Nonsyn. | Coding | | Lung | Non-Small Cell Lung Cancer |
| 39732 | VEGFR2 | Nonsyn. | Coding | Pkinase_Tyr, Pkinase | Breast | Breast Cancer |
| 47112 | VEGFR2 | Nonsyn. | Coding | | Skin | Melanoma |
| 55762 | VEGFR2 | Nonsyn. | Coding | | Lung | Small Cell Lung Cancer |
| 59032 | VEGFR2 | Nonsyn. | Coding | Pkinase_Tyr, Pkinase | Stomach | Gastric Cancer |
| 60047 | VEGFR2 | Nonsyn. | Coding | | Stomach | Gastric Cancer |

GENETIC VARIATIONS ASSOCIATED WITH TUMORS

CROSS-REFERENCE TO RELATED APPLICATIONS

This application is a US National Stage of PCT/US2007/082397, filed Oct. 24, 2007, which claims the benefit of U.S. Provisional Application No. 60/863,106, filed Oct. 26, 2006, and U.S. Provisional Application No. 60/917,814, filed May 14, 2007. The disclosures of the foregoing applications are incorporated herein by reference in their entirety.

REFERENCE TO A SEQUENCE LISTING

The instant application contains a Sequence Listing which has been submitted in ASCII format via EFS-Web and is hereby incorporated by reference in its entirety. Said ASCII copy, created on Apr. 17, 2009, is named P2490R1Sequence.txt and is 993,098 bytes in size.

FIELD OF THE INVENTION

The present invention generally relates to genetic variations associated with tumors.

BACKGROUND

Cancers may arise when cells accumulate somatic mutations that ultimately confer a growth advantage to the cells. Somatic mutations include, e.g., nucleotide base substitutions, deletions, insertions, amplifications, and rearrangements. Identification of somatic mutations that occur in cancer provides valuable information regarding the development of cancer. Such information is also useful for the identification of diagnostic markers and therapeutic targets in cancer. (See, e.g., Bamford et al. (2004) *British Journal of Cancer* 91:355-358.) The identification of somatic mutations associated with cancer has proven valuable in clinical settings, e.g., in distinguishing patient populations that are responsive to a particular therapy. (See, e.g., Lynch et al. (2004) *N. Engl. J. Med.* 350:2129-2139; O'Hare (2004) *Blood* 104:2532-2539.) Thus, a continuing need exists to identify somatic mutations that occur in cancer.

Germline variations, or polymorphisms, are heritable variations that are present in an organism's genome. Polymorphisms include restriction fragment length polymorphisms (RFLPs), short tandem repeats (STRs), and single nucleotide polymorphisms (SNPs). Germline variations may be associated with susceptibility to certain diseases, including cancer. (See, e.g., Vierimaa et al. (2006) *Science* 312:1228-1230; Landi et al. (2006) *Science* 313:521-522; Zhu et al. (2004) *Cancer Research* 64:2251-2257.) Thus, a continuing need exists to identify polymorphisms associated with cancer.

The inventions described herein meet the above-described needs and provides other benefits.

SUMMARY

The compositions and methods of the invention are based, in part, on the discovery of novel variations in polynucleotides derived from tumor samples.

In one aspect, an isolated polynucleotide comprising (a) a PRO polynucleotide or fragment thereof that is at least about 10 nucleotides in length is provided, wherein the PRO polynucleotide or fragment thereof comprises a nucleotide variation at a nucleotide position selected from FIG. 1, or (b) the complement of (a). In one embodiment, the nucleotide variation occurs in SEQ ID NOs: 1-78. In another embodiment, the nucleotide variation is a nucleotide change selected from FIG. 1. In another embodiment, the isolated polynucleotide is a primer. In another embodiment, the isolated polynucleotide is an oligonucleotide.

In another aspect, an oligonucleotide is provided, wherein the oligonucleotide is (a) an allele-specific oligonucleotide that hybridizes to a region of a PRO polynucleotide comprising a nucleotide variation at a nucleotide position selected from FIG. 1, or (b) the complement of (a). In one embodiment, the nucleotide variation is a nucleotide change selected from FIG. 1. In another embodiment, the allele-specific oligonucleotide is an allele-specific primer. In another embodiment, a kit is provided comprising the oligonucleotide and at least one enzyme. In one such embodiment, the at least one enzyme is a polymerase. In another such embodiment, the at least one enzyme is a ligase. In another embodiment, a microarray comprising the oligonucleotide is provided.

In another aspect, a method of detecting the absence or presence of a nucleotide variation at a nucleotide position selected from FIG. 1 is provided, the method comprising (a) contacting nucleic acid suspected of comprising the nucleotide variation with an allele-specific oligonucleotide that is specific for the nucleotide variation under conditions suitable for hybridization of the allele-specific oligonucleotide to the nucleic acid; and (b) detecting the absence or presence of allele-specific hybridization. In one embodiment, the nucleotide variation is a nucleotide change selected from FIG. 1.

In another aspect, a method of amplifying a nucleic acid comprising a nucleotide variation at a nucleotide position selected from FIG. 1 is provided, the method comprising (a) contacting the nucleic acid with a primer that hybridizes to the nucleic acid at a sequence 3' of the nucleotide variation, and (b) extending the primer to generate an amplification product comprising the nucleotide variation. In one embodiment, the nucleotide variation is a nucleotide change selected from FIG. 1.

In another embodiment, a method of determining the genotype of a biological sample from a mammal is provided, the method comprising detecting the absence or presence of a nucleotide variation at a nucleotide position selected from FIG. 1 in nucleic acid material derived from the biological sample. In one embodiment, the nucleotide variation is a nucleotide change selected from FIG. 1. In another embodiment, the biological sample is suspected of comprising tumor cells. In another embodiment, the biological sample is a tumor. In one such embodiment, the tumor is derived from a tissue selected from the tissues listed in column 6 of FIG. 2. In another such embodiment, the tumor is a selected from a tumor listed in column 7 of FIG. 2. In another embodiment, the detecting comprises carrying out a process selected from a primer extension assay; an allele-specific primer extension assay; an allele-specific nucleotide incorporation assay; an allele-specific oligonucleotide hybridization assay; a 5' nuclease assay; an assay employing molecular beacons; and an oligonucleotide ligation assay.

In another aspect, a method of classifying a tumor in a mammal is provided, the method comprising detecting the presence of a variation in a PRO or PRO polynucleotide in a biological sample derived from the mammal, wherein the biological sample is known to or suspected of comprising tumor cells. In one embodiment, the tumor cells are derived from a tissue selected from the tissues listed in column 6 of FIG. 2. In another embodiment, the tumor cells are cells of a tumor selected from the tumors listed in column 7 of FIG. 2.

In another embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the detecting comprises carrying out a process selected from a primer extension assay; an allele-specific primer extension assay; an allele-specific nucleotide incorporation assay; an allele-specific oligonucleotide hybridization assay; a 5' nuclease assay; an assay employing molecular beacons; and an oligonucleotide ligation assay. In another embodiment, the variation is an amino acid variation. In one such embodiment, the amino acid variation is in a PRO functional domain selected from FIG. 2. In one such embodiment, the amino acid variation is at an amino acid position selected from FIG. 1. In one such embodiment, the amino acid variation is an amino acid change selected from FIG. 1.

In another embodiment, an amino acid variation is in a PIK3R1 polypeptide, wherein said amino acid variation increases activity of a PIK3CA polypeptide. In another embodiment, an amino acid variation is in a PIK3R1 polypeptide at an amino acid position selected from 162R, 285N, 348R, 380L, 449L, 527N, 543R, 564N, 642R, 649R, 666E, 669H, and 682A. In one such embodiment, the amino acid variation is an amino acid change selected from 162R>O, 285N>H, 348R>O, 449L>S, 527N>K, 543R>I, 564N>D, 642R>O, 649R>Q, 666E>K, and 682A>V. In another embodiment, a nucleotide variation is in a PIK3R1 polynucleotide at a nucleotide position selected from nucleotide 895A, 1084C, 1623T, 1732A, 1988G, 1966C, 2038G, 2087C, 526C, 1182A, 1388T, 1670G, and 2047C. In one such embodiment, the nucleotide variation is a nucleotide change selected from 895A>C, 1084C>T, 1623T>G, 1732A>G, 1988G>A, 1966C>T, 2038G>A, 2087C>T, 526C>T, 1388T>C, and 1670G>T.

In another embodiment, an amino acid variation is in a PIK3CA polypeptide at an amino acid position selected from 471P, 38R, 726E, and 12G. In another embodiment, a nucleotide variation is in a PIK3CA polynucleotide at a nucleotide position selected from 1568C, 269C, 2333G and 192G. In another embodiment, an amino acid variation is in a PTEN polypeptide at an amino acid position selected from 28I, 232R, 31N, 3A, and 260Q. In another embodiment, a nucleotide variation is in a PTEN polynucleotide at a nucleotide position selected from 1115T, 1725C, 1122A, 1039C, and 1809C.

In another aspect, a method for predicting whether a tumor will respond to a therapeutic agent that targets a PRO or a PRO polynucleotide is provided, the method comprising determining whether the tumor comprises a variation in a PRO or PRO polynucleotide, wherein the presence of a variation indicates that the tumor will respond to the therapeutic agent. In one embodiment, the tumor is derived from a tissue selected from the tissues listed in column 6 of FIG. 2. In another embodiment, the tumor is a selected from a tumor listed in column 7 of FIG. 2. In another embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the variation is an amino acid variation. In one such embodiment, the amino acid variation is in a PRO functional domain selected from FIG. 2. In another such embodiment, the amino acid variation is at an amino acid position selected from FIG. 1. In one such embodiment, the amino acid variation is an amino acid change selected from FIG. 1.

These and further embodiments are described in the following written description.

BRIEF DESCRIPTION OF THE FIGURES

FIG. 1 is a table of nucleotide and amino acid variations identified in selected genes from tumors, as described in Example A.

FIG. 2 provides additional information regarding the variations reported in FIG. 1.

DETAILED DESCRIPTION OF EMBODIMENTS

I. Definitions

Figure 3:
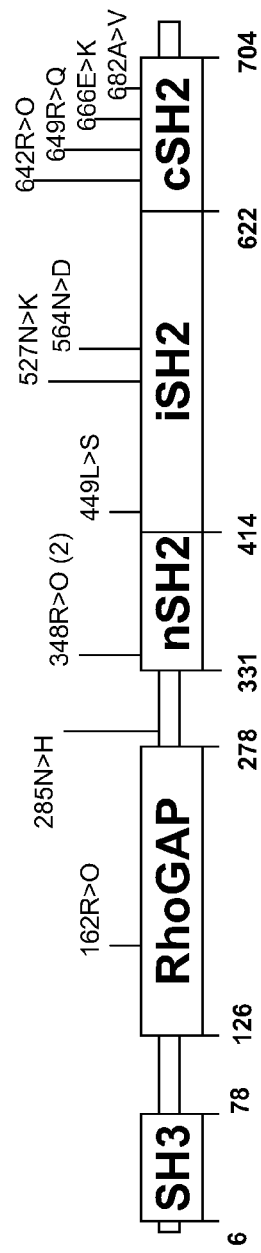
FIG. 3 shows somatic mutations discovered in PIK3R1, which encodes p85α, as described in Example B.

For purposes of interpreting this specification, the following definitions will apply and whenever appropriate, terms used in the singular will also include the plural and vice versa. In the event that any definition set forth below conflicts with any document incorporated herein by reference, the definition set forth below shall control.

The term "polynucleotide" or "nucleic acid," as used interchangeably herein, refers to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase. A polynucleotide may comprise modified nucleotides, such as methylated nucleotides and their analogs. If present, modification to the nucleotide structure may be imparted before or after assembly of the polymer. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping groups moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-2'-O-allyl, 2'-fluoro- or 2'-azido-ribose, carbocyclic sugar analogs, α-anomeric sugars, epimeric sugars such as arabinose, xyloses or lyxoses, pyranose sugars, furanose sugars, sedoheptuloses, acyclic analogs and a basic nucleoside analogs such as methyl riboside. One or more phosphodiester linkages may be replaced by alternative linking groups. These alternative linking groups include, but are not limited to, embodiments wherein phosphate is replaced by P(O)S ("thioate"), P(S)S ("dithioate"), "(O)NR 2 ("amidate"), P(O)R, P(O)OR', CO or CH 2 ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

"Oligonucleotide," as used herein, refers to short, single stranded polynucleotides that are at least about seven nucleotides in length and less than about 250 nucleotides in length. Oligonucleotides may be synthetic. The terms "oligonucleotide" and "polynucleotide" are not mutually exclusive. The description above for polynucleotides is equally and fully applicable to oligonucleotides.

The term "primer" refers to a single stranded polynucleotide that is capable of hybridizing to a nucleic acid and allowing the polymerization of a complementary nucleic acid, generally by providing a free 3'-OH group.

The term "PRO" refers to a protein encoded by any of the genes listed in FIG. 1, including wild-type and variant forms thereof. Such forms include "full-length," unprocessed forms of PRO; forms of PRO that result from cellular processing; naturally occurring PRO variants, e.g., PRO resulting from alternative splicing, allelic variations, or spontaneous mutation; and fragments or variants of a native PRO that maintain at least one biological activity of PRO, unless otherwise indicated.

The term "PRO polynucleotide" or "nucleic acid encoding PRO" refers to a gene or coding sequence (e.g., an mRNA or cDNA coding sequence) that encodes a PRO, unless otherwise indicated.

The term "nucleotide variation" refers to a change in a nucleotide sequence (e.g., an insertion, deletion, inversion, or substitution of one or more nucleotides, such as a single nucleotide polymorphism (SNP)) relative to a reference sequence (e.g., a wild type sequence). The term also encompasses the corresponding change in the complement of the nucleotide sequence, unless otherwise indicated. A nucleotide variation may be a somatic mutation or a germline polymorphism.

The term "amino acid variation" refers to a change in an amino acid sequence (e.g., an insertion, substitution, or deletion of one or more amino acids, such as an internal deletion or an N- or C-terminal truncation) relative to a reference sequence.

The term "variation" refers to either a nucleotide variation or an amino acid variation.

The term "a nucleotide variation at a nucleotide position selected from FIG. 1" and grammatical variants thereof refer to a nucleotide variation in a PRO polynucleotide sequence at any of the nucleotide positions listed in column 6 of FIG. 1, including but not limited to the specific nucleotide changes listed in column 6 of FIG. 1. For example and for purposes of illustration, with reference to column 6 in the fifth data row of FIG. 1, a nucleotide variation at nucleotide position 505 of an AKT2 polynucleotide encompasses any change at that nucleotide position, including but not limited to the specific nucleotide change, i.e., the G/T substitution, indicated in column 6. The term also encompasses the corresponding change in the complement of the nucleotide sequence, unless otherwise indicated.

The term "a nucleotide change selected from FIG. 1" and grammatical variants thereof refer to any of the specific nucleotide changes listed in column 6 of FIG. 1. For purposes of illustration, an example of a nucleotide change selected from FIG. 1 is the G/T substitution at nucleotide position 505 of an AKT2 polynucleotide, as shown in column 6 in the fifth data row of FIG. 1.

The term "an amino acid variation at an amino acid position selected from FIG. 1" and grammatical variants thereof refer to an amino acid variation in a PRO amino acid sequence at any of the amino acid positions listed in column 7 of FIG. 1, including but not limited to the specific amino acid changes listed in column 7 of FIG. 1. For example and for purposes of illustration, with reference to column 7 in the fifth data row of FIG. 1, an amino acid variation at amino acid position 101 of AKT2 encompasses any change at that amino acid position, including but not limited to the specific amino acid change, i.e., the R>L substitution, indicated in column 7.

The term "an amino acid change selected from FIG. 1" and grammatical variants thereof refer to any of the specific amino acid changes listed in column 7 of FIG. 1. For purposes of illustration, an example of an amino acid change selected from FIG. 1 is the R>L substitution at amino acid position 101 of AKT2, as shown in column 7 in the fifth data row of FIG. 1.

The term "PRO functional domain" refers to any of the protein domains listed in column 5 of FIG. 2.

The term "activating variation" refers to a variation in a gene or coding sequence that results in a more active form of the encoded polypeptide, relative to the wild type polypeptide.

The term "array" or "microarray" refers to an ordered arrangement of hybridizable array elements, preferably polynucleotide probes (e.g., oligonucleotides), on a substrate. The substrate can be a solid substrate, such as a glass slide, or a semi-solid substrate, such as nitrocellulose membrane.

The term "amplification" refers to the process of producing one or more copies of a reference nucleic acid sequence or its complement. Amplification may be linear or exponential (e.g., PCR). A "copy" does not necessarily mean perfect sequence complementarity or identity relative to the template sequence. For example, copies can include nucleotide analogs such as deoxyinosine, intentional sequence alterations (such as sequence alterations introduced through a primer comprising a sequence that is hybridizable, but not fully complementary, to the template), and/or sequence errors that occur during amplification.

The term "allele-specific oligonucleotide" refers to an oligonucleotide that hybridizes to a region of a target nucleic acid that comprises a nucleotide variation (generally a substitution). "Allele-specific hybridization" means that, when an allele-specific oligonucleotide is hybridized to its target nucleic acid, a nucleotide in the allele-specific oligonucleotide specifically base pairs with the nucleotide variation. An allele-specific oligonucleotide capable of allele-specific hybridization with respect to a particular nucleotide variation is said to be "specific for" that variation.

The term "allele-specific primer" refers to an allele-specific oligonucleotide that is a primer.

The term "primer extension assay" refers to an assay in which nucleotides are added to a nucleic acid, resulting in a longer nucleic acid, or "extension product," that is detected directly or indirectly.

The term "allele-specific nucleotide incorporation assay" refers to a primer extension assay in which a primer is (a) hybridized to target nucleic acid at a region that is 3' of a nucleotide variation and (b) extended by a polymerase, thereby incorporating into the extension product a nucleotide that is complementary to the nucleotide variation.

The term "allele-specific primer extension assay" refers to a primer extension assay in which an allele-specific primer is hybridized to a target nucleic acid and extended.

The term "allele-specific oligonucleotide hybridization assay" refers to an assay in which (a) an allele-specific oligonucleotide is hybridized to a target nucleic acid and (b) hybridization is detected directly or indirectly.

The term "5'nuclease assay" refers to an assay in which hybridization of an allele-specific oligonucleotide to a target nucleic acid allows for nucleolytic cleavage of the hybridized probe, resulting in a detectable signal.

The term "assay employing molecular beacons" refers to an assay in which hybridization of an allele-specific oligonucleotide to a target nucleic acid results in a level of detectable signal that is higher than the level of detectable signal emitted by the free oligonucleotide.

The term "oligonucleotide ligation assay" refers to an assay in which an allele-specific oligonucleotide and a second oligonucleotide are hybridized adjacent to one another on a target nucleic acid and ligated together (either directly or indirectly through intervening nucleotides), and the ligation product is detected directly or indirectly.

The term "target sequence," "target nucleic acid," or "target nucleic acid sequence" refers generally to a polynucleotide sequence of interest in which a nucleotide variation is suspected or known to reside, including copies of such target nucleic acid generated by amplification.

The term "detection" includes any means of detecting, including direct and indirect detection.

The term "diagnosis" is used herein to refer to the identification or classification of a molecular or pathological state, disease or condition. For example, "diagnosis" may refer to identification of a particular type of cancer, e.g., a lung cancer. "Diagnosis" may also refer to the classification of a particular type of cancer, e.g., by histology (e.g., a non small cell lung carcinoma), by molecular features (e.g., a lung cancer characterized by nucleotide and/or amino acid variation(s) in a particular gene or protein), or both.

The term "prognosis" is used herein to refer to the prediction of the likelihood of cancer-attributable death or progression, including, for example, recurrence, metastatic spread, and drug resistance, of a neoplastic disease, such as cancer.

The term "prediction" is used herein to refer to the likelihood that a patient will respond either favorably or unfavorably to a drug or set of drugs. In one embodiment, the prediction relates to the extent of those responses. In another embodiment, the prediction relates to whether and/or the probability that a patient will survive following treatment, for example treatment with a particular therapeutic agent and/or surgical removal of the primary tumor, and/or chemotherapy for a certain period of time without cancer recurrence. The predictive methods of the invention can be used clinically to make treatment decisions by choosing the most appropriate treatment modalities for any particular patient. The predictive methods of the present invention are valuable tools in predicting if a patient is likely to respond favorably to a treatment regimen, such as a given therapeutic regimen, including for example, administration of a given therapeutic agent or combination, surgical intervention, chemotherapy, etc., or whether long-term survival of the patient, following a therapeutic regimen is likely.

The terms "cell proliferative disorder" and "proliferative disorder" refer to disorders that are associated with a measurable degree of abnormal cell proliferation. In one embodiment, the cell proliferative disorder is cancer.

"Tumor," as used herein, refers to all neoplastic cell growth and proliferation, whether malignant or benign, and all pre-cancerous and cancerous cells and tissues. The terms "cancer," "cancerous," "cell proliferative disorder," "proliferative disorder" and "tumor" are not mutually exclusive as referred to herein.

The terms "cancer" and "cancerous" refer to or describe the physiological condition in mammals that is typically characterized by unregulated cell growth and proliferation. Examples of cancer include, but are not limited to, carcinoma, lymphoma (e.g., Hodgkin's and non-Hodgkin's lymphoma), blastoma, sarcoma, and leukemia. More particular examples of cancers include squamous cell cancer, small-cell lung cancer, non-small cell lung cancer, adenocarcinoma of the lung, squamous carcinoma of the lung, cancer of the peritoneum, hepatocellular cancer, renal cell carcinoma, gastrointestinal cancer, gastric cancer, esophageal cancer, pancreatic cancer, glioma, cervical cancer, ovarian cancer, liver cancer, bladder cancer, hepatoma, breast cancer, colon cancer, rectal cancer, lung cancer, endometrial or uterine carcinoma, salivary gland carcinoma, kidney cancer, liver cancer, prostate cancer, vulval cancer, thyroid cancer, hepatic carcinoma, melanoma, leukemia and other lymphoproliferative disorders, and various types of head and neck cancer.

The term "lung tumor" refers to any tumor of the lung, including but not limited to small-cell lung carcinoma and non-small cell lung carcinoma, the latter including but not limited to adenocarcinoma, squamous carcinoma, and large cell carcinoma.

The term "neoplasm" or "neoplastic cell" refers to an abnormal tissue or cell that proliferates more rapidly than corresponding normal tissues or cells and continues to grow after removal of the stimulus that initiated the growth.

A "lung tumor cell" refers to a lung tumor cell, either in vivo or in vitro, and encompasses cells derived from primary lung tumors or metastatic lung tumors, as well as cell lines derived from such cells.

As used herein, "treatment" (and variations such as "treat" or "treating") refers to clinical intervention in an attempt to alter the natural course of the individual or cell being treated, and can be performed either for prophylaxis or during the course of clinical pathology. Desirable effects of treatment include preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

An "individual," "subject" or "patient" is a vertebrate. In certain embodiments, the vertebrate is a mammal. Mammals include, but are not limited to, farm animals (such as cows), sport animals, pets (such as cats, dogs, and horses), primates (including human and non-human primates), and rodents (e.g., mice and rats). In certain embodiments, a mammal is a human.

An "effective amount" refers to an amount effective, at dosages and for periods of time necessary, to achieve the desired therapeutic or prophylactic result.

A "therapeutically effective amount" of a substance/molecule of the invention may vary according to factors such as the disease state, age, sex, and weight of the individual, and the ability of the substance/molecule, to elicit a desired response in the individual. A therapeutically effective amount encompasses an amount in which any toxic or detrimental effects of the substance/molecule are outweighed by the therapeutically beneficial effects. A "prophylactically effective amount" refers to an amount effective, at dosages and for periods of time necessary, to achieve the desired prophylactic result. Typically, but not necessarily, since a prophylactic dose is used in subjects prior to or at an earlier stage of disease, the prophylactically effective amount would be less than the therapeutically effective amount.

The term "long-term" survival is used herein to refer to survival for at least 1 year, 5 years, 8 years, or 10 years following therapeutic treatment.

The term "increased resistance" to a particular therapeutic agent or treatment option, when used in accordance with the invention, means decreased response to a standard dose of the drug or to a standard treatment protocol.

The term "decreased sensitivity" to a particular therapeutic agent or treatment option, when used in accordance with the invention, means decreased response to a standard dose of the agent or to a standard treatment protocol, where decreased response can be compensated for (at least partially) by increasing the dose of agent, or the intensity of treatment.

"Patient response" can be assessed using any endpoint indicating a benefit to the patient, including, without limitation, (1) inhibition, to some extent, of tumor growth, including slowing down or complete growth arrest; (2) reduction in the number of tumor cells; (3) reduction in tumor size; (4) inhibition (i.e., reduction, slowing down or complete stopping) of tumor cell infiltration into adjacent peripheral organs and/or tissues; (5) inhibition (i.e. reduction, slowing down or complete stopping) of metastasis; (6) enhancement of anti-tumor immune response, which may, but does not have to, result in the regression or rejection of the tumor; (7) relief, to some extent, of one or more symptoms associated with the tumor; (8) increase in the length of survival following treatment; and/or (9) decreased mortality at a given point of time following treatment.

The term "antagonist" is used in the broadest sense, and includes any molecule that partially or fully inhibits or neutralizes a biological activity of a polypeptide, such as PRO, or that partially or fully inhibits the transcription or translation of a nucleic acid encoding the polypeptide. Exemplary antagonist molecules include, but are not limited to, antagonist antibodies, polypeptide fragments, oligopeptides, organic molecules (including small molecules), and antisense nucleic acids.

The term "agonist" is used in the broadest sense, and includes any molecule that partially or fully mimics a biological activity of a polypeptide, such as PRO, or that increases the transcription or translation of a nucleic acid encoding the polypeptide. Exemplary agonist molecules include, but are not limited to, agonist antibodies, polypeptide fragments, oligopeptides, organic molecules (including small molecules), PRO polynucleotides, PRO polypeptides, and PRO-Fc fusions.

A "therapeutic agent that targets a PRO or a PRO polynucleotide" means any agent that affects the expression and/or activity of PRO or a PRO polynucleotide including, but not limited to, any of the PRO agonists or antagonists described herein, including such therapeutic agents that are already known in the art as well as those that are later developed.

The term "cytotoxic agent" as used herein refers to a substance that inhibits or prevents a cellular function and/or causes cell death or destruction. The term is intended to include radioactive isotopes (e.g., $At^{211}$, $I^{131}$, $I^{125}$, $Y^{90}$, $Re^{186}$, $Re^{188}$, $Sm^{153}$, $Bi^{212}$, $P^{32}$, $Pb^{212}$ and radioactive isotopes of Lu), chemotherapeutic agents (e.g., methotrexate, adriamicin, vinca alkaloids (vincristine, vinblastine, etoposide), doxorubicin, melphalan, mitomycin C, chlorambucil, daunorubicin or other intercalating agents, enzymes and fragments thereof such as nucleolytic enzymes, antibiotics, and toxins such as small molecule toxins or enzymatically active toxins of bacterial, fungal, plant or animal origin, including fragments and/or variants thereof, and the various antitumor or anticancer agents disclosed below. Other cytotoxic agents are described below. A "tumoricidal" agent causes destruction of tumor cells.

A "toxin" is any substance capable of having a detrimental effect on the growth or proliferation of a cell.

A "chemotherapeutic agent" is a chemical compound useful in the treatment of cancer. Examples of chemotherapeutic agents include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine; acetogenins (especially bullatacin and bullatacinone); delta-9-tetrahydrocannabinol (dronabinol, MARINOL®); beta-lapachone; lapachol; colchicines; betulinic acid; a camptothecin (including the synthetic analogue topotecan (HYCAMTIN®), CPT-11 (irinotecan, CAMPTOSAR®), acetylcamptothecin, scopolectin, and 9-aminocamptothecin); bryostatin; callystatin; CC-1065 (including its adozelesin, carzelesin and bizelesin synthetic analogues); podophyllotoxin; podophyllinic acid; teniposide; cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlomaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omega1I (see, e.g., Agnew, Chem Intl. Ed. Engl., 33: 183-186 (1994)); dynemicin, including dynemicin A; an esperamicin; as well as neocarzinostatin chromophore and related chromoprotein enediyne antibiotic chromophores), aclacinomysins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxy-doxorubicin), epirubicin, esorubicin, idarubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine (ELDISINE®, FILDESIN®); dacarbazine; mannomustine; mitobronitol; mitolactol; pipobroman; gacytosine; arabinoside ("Ara-C"); thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® docetaxel (Rhône-Poulenc Rorer, Antony, France); chloranbucil; gemcitabine (GEMZAR®); 6-thioguanine; mercaptopurine; methotrexate; platinum analogs such as cisplatin and carboplatin; vinblastine (VELBAN®); platinum; etoposide (VP-16); ifosfamide; mitoxantrone; vincristine (ONCOVIN®); oxaliplatin; leucovovin; vinorelbine (NAVELBINE®); novantrone; edatrexate; daunomycin; aminopterin; ibandronate; topoisomerase inhibitor RFS 2000; difluoromethylornithine (DMFO); retinoids such as retinoic acid; capecitabine (XELODA®); pharmaceutically acceptable salts, acids or derivatives of any of the above; as well as combinations of two or more of the above such as CHOP, an abbreviation for a combined therapy of cyclophosphamide, doxorubicin, vincristine, and prednisolone, and FOLFOX, an abbreviation for a treatment regimen with oxaliplatin (ELOXATIN™) combined with 5-FU and leucovovin.

Also included in this definition are anti-hormonal agents that act to regulate, reduce, block, or inhibit the effects of hormones that can promote the growth of cancer, and are often in the form of systemic, or whole-body treatment. They may be hormones themselves. Examples include anti-estrogens and selective estrogen receptor modulators (SERMs), including, for example, tamoxifen (including NOLVADEX® tamoxifen), EVISTA® raloxifene, droloxifene, 4-hydroxytamoxifen, trioxifene, keoxifene, LY117018, onapristone, and FARESTON® toremifene; anti-progesterones; estrogen receptor down-regulators (ERDs); agents that function to suppress or shut down the ovaries, for example, leutinizing hormone-releasing hormone (LHRH) agonists such as LUPRON® and ELIGARD® leuprolide acetate, goserelin acetate, buserelin acetate and triptorelin; other anti-androgens such as flutamide, nilutamide and bicalutamide; and aromatase inhibitors that inhibit the enzyme aromatase, which regulates estrogen production in the adrenal glands, such as, for example, 4(5)-imidazoles, aminoglutethimide, MEGASE® megestrol acetate, AROMASIN® exemestane, formestanie, fadrozole, RIVISOR® vorozole, FEMARA® letrozole, and ARIMIDEX® anastrozole. In addition, such definition of chemotherapeutic agents includes bisphosphonates such as clodronate (for example, BONEFOS® or OSTAC®), DIDROCAL® etidronate, NE-58095, ZOMETA® zoledronic acid/zoledronate, FOSAMAX® alendronate, AREDIA® pamidronate, SKELID® tiludronate, or ACTONEL® risedronate; as well as troxacitabine (a 1,3-dioxolane nucleoside cytosine analog); antisense oligonucleotides, particularly those that inhibit expression of genes in signaling pathways implicated in abherant cell proliferation, such as, for example, PKC-alpha, Raf, H-Ras, and epidermal growth factor receptor (EGF-R); vaccines such as THERATOPE® vaccine and gene therapy vaccines, for example, ALLOVECTIN® vaccine, LEUVECTIN® vaccine, and VAXID® vaccine; LURTOTECAN® topoisomerase 1 inhibitor; ABARELIX® rmRH; lapatinib ditosylate (an ErbB-2 and EGFR dual tyrosine kinase small-molecule inhibitor also known as GW572016); and pharmaceutically acceptable salts, acids or derivatives of any of the above.

A "growth inhibitory agent" when used herein refers to a compound or composition which inhibits growth of a cell (such as a cell expressing PRO) either in vitro or in vivo. Thus, the growth inhibitory agent may be one which significantly reduces the percentage of cells (such as a cell expressing PRO) in S phase. Examples of growth inhibitory agents include agents that block cell cycle progression (at a place other than S phase), such as agents that induce G1 arrest and M-phase arrest. Classical M-phase blockers include the vincas (vincristine and vinblastine), taxanes, and topoisomerase II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil, and ara-C. Further information can be found in *The Molecular Basis of Cancer*, Mendelsohn and Israel, eds., Chapter 1, entitled "Cell cycle regulation, oncogenes, and antineoplastic drugs" by Murakami et al. (WB Saunders: Philadelphia, 1995), especially p. 13. The taxanes (paclitaxel and docetaxel) are anticancer drugs both derived from the yew tree. Docetaxel (TAXOTERE®, Rhone-Poulenc Rorer), derived from the European yew, is a semisynthetic analogue of paclitaxel (TAXOL®, Bristol-Myers Squibb). Paclitaxel and docetaxel promote the assembly of microtubules from tubulin dimers and stabilize microtubules by preventing depolymerization, which results in the inhibition of mitosis in cells.

As used herein, the term "EGFR inhibitor" refers to compounds that bind to or otherwise interact directly with EGFR and prevent or reduce its signaling activity, and is alternatively referred to as an "EGFR antagonist." Examples of such agents include antibodies and small molecules that bind to EGFR. Examples of antibodies which bind to EGFR include MAb 579 (ATCC CRL HB 8506), MAb 455 (ATCC CRL HB8507), MAb 225 (ATCC CRL 8508), MAb 528 (ATCC CRL 8509) (see, U.S. Pat. No. 4,943,533, Mendelsohn et al.) and variants thereof, such as chimerized 225 (C225 or Cetuximab; ERBITUX®) and reshaped human 225 (H225) (see, WO 96/40210, Imclone Systems Inc.); IMC-11F8, a fully human, EGFR-targeted antibody (Imclone); antibodies that bind type II mutant EGFR (U.S. Pat. No. 5,212,290); humanized and chimeric antibodies that bind EGFR as described in U.S. Pat. No. 5,891,996; and human antibodies that bind EGFR, such as ABX-EGF or Panitumumab (see WO98/50433, Abgenix/Amgen); EMD 55900 (Stragliotto et al. *Eur. J. Cancer* 32A:636-640 (1996)); EMD7200 (matuzumab) a humanized EGFR antibody directed against EGFR that competes with both EGF and TGF-alpha for EGFR binding (EMD/Merck); human EGFR antibody, HuMax-EGFR (GenMab); fully human antibodies known as E1.1, E2.4, E2.5, E6.2, E6.4, E2.11, E6. 3 and E7.6. 3 and described in U.S. Pat. No. 6,235,883; MDX-447 (Medarex Inc); and mAb 806 or humanized mAb 806 (Johns et al., *J. Biol. Chem.* 279(29):30375-30384 (2004)). The anti-EGFR antibody may be conjugated with a cytotoxic agent, thus generating an immunoconjugate (see, e.g., EP659,439A2, Merck Patent GmbH). EGFR antagonists include small molecules such as compounds described in U.S. Pat. Nos. 5,616,582, 5,457,105, 5,475,001, 5,654,307, 5,679,683, 6,084,095, 6,265,410, 6,455,534, 6,521,620, 6,596,726, 6,713,484, 5,770,599, 6,140,332, 5,866,572, 6,399,602, 6,344,459, 6,602,863, 6,391,874, 6,344,455, 5,760,041, 6,002,008, and 5,747,498, as well as the following PCT publications: WO98/14451, WO98/50038, WO99/09016, and WO99/24037. Particular small molecule EGFR antagonists include OSI-774 (CP-358774, erlotinib, TARCEVA® Genentech/OSI Pharmaceuticals); PD 183805 (CI 1033, 2-propenamide, N-[4-[(3-chloro-4-fluorophenyl)amino]-7-[3-(4-morpholinyl) propoxy]-6-quinazolinyl]-, dihydrochloride, Pfizer Inc.); ZD1839, gefitinib (IRESSA™) 4-(3'-Chloro-4'-fluoroanilino)-7-methoxy-6-(3-morpholinopropoxy)quinazoline, AstraZeneca); ZM 105180 ((6-amino-4-(3-methylphenyl-amino)-quinazoline, Zeneca); BIBX-1382 (N8-(3-chloro-4-fluoro-phenyl)-N2-(1-methyl-piperidin-4-yl)-pyrimido[5,4-d]pyrimidine-2,8-diamine, Boehringer Ingelheim); PKI-166 ((R)-4-[4-[(1-phenylethyl)amino]-1H-pyrrolo[2,3-d]pyrimidin-6-yl]-phenol); (R)-6-(4-hydroxyphenyl)-4-[(1-phenylethyl)amino]-7H-pyrrolo[2,3-d]pyrimidine); CL-387785 (N-[4-[(3-bromophenyl)amino]-6-quinazolinyl]-2-butynamide); EKB-569 (N-[4-[(3-chloro-4-fluorophenyl)amino]-3-cyano-7-ethoxy-6-quinolinyl]-4-(dimethylamino)-2-butenamide) (Wyeth); AG1478 (Pfizer); AG1571 (SU 5271; Pfizer); dual EGFR/HER2 tyrosine kinase inhibitors such as lapatinib (TYKERB®, GSK572016 or N-[3-chloro-4-[(3 fluorophenyl)methoxy]phenyl]6[5[[[2-methylsulfonyl)ethyl]amino] methyl]-2-furanyl]-4-quinazolinamine; Glaxo-SmithKline).

A "tyrosine kinase inhibitor" is a molecule which inhibits tyrosine kinase activity of a tyrosine kinase such as a HER receptor. Examples of such inhibitors include the EGFR-targeted drugs noted in the preceding paragraph; small molecule HER2 tyrosine kinase inhibitor such as TAK165 available from Takeda; CP-724,714, an oral selective inhibitor of the ErbB2 receptor tyrosine kinase (Pfizer and OSI); dual-HER inhibitors such as EKB-569 (available from Wyeth) which preferentially binds EGFR but inhibits both HER2 and EGFR-overexpressing cells; lapatinib (GSK572016; available from Glaxo-SmithKline), an oral HER2 and EGFR tyrosine kinase inhibitor; PKI-166 (available from Novartis); pan-HER inhibitors such as canertinib (CI-1033; Pharmacia); Raf-1 inhibitors such as antisense agent ISIS-5132 available from ISIS Pharmaceuticals which inhibit Raf-1 signaling; non-HER targeted TK inhibitors such as imatinib mesylate (GLEEVEC™, available from Glaxo SmithKline); multi-targeted tyrosine kinase inhibitors such as sunitinib (SUTENT®, available from Pfizer); VEGF receptor tyrosine kinase inhibitors such as vatalanib (PTK787/ZK222584, available from Novartis/Schering AG); MAPK extracellular regulated kinase I inhibitor CI-1040 (available from Pharmacia); quinazolines, such as PD 153035,4-(3-chloroanilino) quinazoline; pyridopyrimidines; pyrimidopyrimidines; pyrrolopyrimidines, such as CGP 59326, CGP 60261 and CGP 62706; pyrazolopyrimidines, 4-(phenylamino)-7H-pyrrolo [2,3-d]pyrimidines; curcumin (diferuloyl methane, 4,5-bis(4-fluoroanilino)phthalimide); tyrphostines containing nitrothiophene moieties; PD-0183805 (Warner-Lamber); antisense molecules (e.g. those that bind to HER-encoding nucleic acid); quinoxalines (U.S. Pat. No. 5,804,396); tyrphostins (U.S. Pat. No. 5,804,396); ZD6474 (Astra Zeneca); PTK-787 (Novartis/Schering AG); pan-HER inhibitors such as CI-1033 (Pfizer); Affinitac (ISIS 3521; Isis/Lilly); imatinib mesylate (GLEEVEC™); PKI 166 (Novartis); GW2016 (Glaxo SmithKline); CI-1033 (Pfizer); EKB-569 (Wyeth); Semaxinib (Pfizer); ZD6474 (AstraZeneca); PTK-787 (Novartis/Schering AG); INC-1C11 (Imclone); or as described in any of the following patent publications: U.S. Pat. No. 5,804, 396; WO 1999/09016 (American Cyanamid); WO 1998/ 43960 (American Cyanamid); WO 1997/38983 (Warner Lambert); WO 1999/06378 (Warner Lambert); WO 1999/ 06396 (Warner Lambert); WO 1996/30347 (Pfizer, Inc); WO 1996/33978 (Zeneca); WO 1996/3397 (Zeneca); and WO 1996/33980 (Zeneca).

"Antibodies" (Abs) and "immunoglobulins" (Igs) refer to glycoproteins having similar structural characteristics. While antibodies exhibit binding specificity to a specific antigen, immunoglobulins include both antibodies and other antibody-like molecules which generally lack antigen specificity. Polypeptides of the latter kind are, for example, produced at low levels by the lymph system and at increased levels by myelomas.

The terms "antibody" and "immunoglobulin" are used interchangeably in the broadest sense and include monoclonal antibodies (e.g., full length or intact monoclonal antibodies), polyclonal antibodies, monovalent antibodies, multivalent antibodies, multispecific antibodies (e.g., bispecific antibodies so long as they exhibit the desired biological activity) and may also include certain antibody fragments (as described in greater detail herein). An antibody can be chimeric, human, humanized and/or affinity matured.

The term "anti-PRO antibody" or "an antibody that binds to PRO" refers to an antibody that is capable of binding PRO with sufficient affinity such that the antibody is useful as a diagnostic and/or therapeutic agent in targeting PRO. Preferably, the extent of binding of an anti-PRO antibody to an unrelated, non-PRO protein is less than about 10% of the binding of the antibody to PRO as measured, e.g., by a radioimmunoassay (RIA). In certain embodiments, an antibody that binds to PRO has a dissociation constant (Kd) of ≤1 µM, ≤100 nM, ≤10 nM, ≤1 nM, or ≤0.1 nM. In certain embodiments, an anti-PRO antibody binds to an epitope of PRO that is conserved among PRO from different species.

The terms "full length antibody," "intact antibody" and "whole antibody" are used herein interchangeably to refer to an antibody in its substantially intact form, not antibody fragments as defined below. The terms particularly refer to an antibody with heavy chains that contain the Fc region.

"Antibody fragments" comprise a portion of an intact antibody, preferably comprising the antigen binding region thereof. Examples of antibody fragments include Fab, Fab', F(ab')$_2$, and Fv fragments; diabodies; linear antibodies; single-chain antibody molecules; and multispecific antibodies formed from antibody fragments.

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')$_2$ fragment that has two antigen-combining sites and is still capable of cross-linking antigen.

"Fv" is a minimum antibody fragment which contains a complete antigen-binding site. In one embodiment, a two-chain Fv species consists of a dimer of one heavy- and one light-chain variable domain in tight, non-covalent association. Collectively, the six CDRs of an Fv confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment contains the heavy- and light-chain variable domains and also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

"Single-chain Fv" or "scFv" antibody fragments comprise the VH and VL domains of antibody, wherein these domains are present in a single polypeptide chain. Generally, the scFv polypeptide further comprises a polypeptide linker between the VH and VL domains which enables the scFv to form the desired structure for antigen binding. For a review of scFv see Pluckthun, in *The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain (VH) connected to a light-chain variable domain (VL) in the same polypeptide chain (VH-VL). By using a linker that is too short to allow pairing between the two domains on the same chain, the domains are forced to pair with the complementary domains of another chain and create two antigen-binding sites. Diabodies may be bivalent or bispecific. Diabodies are described more fully in, for example, EP 404,097; WO93/1161; Hudson et al. (2003) *Nat. Med.* 9:129-134; and Hollinger et al., *Proc. Natl. Acad. Sci. USA* 90: 6444-6448 (1993). Triabodies and tetrabodies are also described in Hudson et al. (2003) *Nat. Med.* 9:129-134.

The term "monoclonal antibody" as used herein refers to an antibody obtained from a population of substantially homogeneous antibodies, i.e., the individual antibodies comprising the population are identical except for possible mutations, e.g., naturally occurring mutations, that may be present in minor amounts. Thus, the modifier "monoclonal" indicates the character of the antibody as not being a mixture of discrete antibodies. In certain embodiments, such a monoclonal antibody typically includes an antibody comprising a polypeptide sequence that binds a target, wherein the target-binding polypeptide sequence was obtained by a process that includes the selection of a single target binding polypeptide sequence from a plurality of polypeptide sequences. For example, the selection process can be the selection of a unique clone from a plurality of clones, such as a pool of hybridoma clones, phage clones, or recombinant DNA clones. It should be understood that a selected target binding sequence can be further altered, for example, to improve affinity for the target, to humanize the target binding sequence, to improve its production in cell culture, to reduce its immunogenicity in vivo, to create a multispecific antibody, etc., and that an antibody comprising the altered target binding sequence is also a monoclonal antibody of this invention. In contrast to polyclonal antibody preparations which typically include different antibodies directed against different determinants (epitopes), each monoclonal antibody of a monoclonal antibody preparation is directed against a single determinant on an antigen. In addition to their specificity, monoclonal antibody preparations are advantageous in that they are typically uncontaminated by other immunoglobulins.

The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including, for example, the hybridoma method (e.g., Kohler et al., *Nature,* 256: 495 (1975); Harlow et al., *Antibodies: A Laboratory Manual,* (Cold Spring Harbor Laboratory Press, 2$^{nd}$ ed. 1988); Hammerling et al., in: *Monoclonal Antibodies and T-Cell Hybridomas* 563-681 (Elsevier, N.Y., 1981)), recombinant DNA methods (see, e.g., U.S. Pat. No. 4,816,567), phage display technologies (see, e.g., Clackson et al., *Nature,* 352: 624-628 (1991); Marks et al., *J. Mol. Biol.* 222: 581-597 (1992); Sidhu et al., *J. Mol. Biol.* 338(2): 299-310 (2004); Lee et al., *J. Mol. Biol.* 340(5): 1073-1093 (2004); Fellouse, *Proc. Natl. Acad. Sci. USA* 101 (34): 12467-12472 (2004); and Lee et al., *J. Immunol. Methods* 284(1-2): 119-132 (2004), and technologies for producing human or human-like antibodies in animals that have parts or all of the human immunoglobulin loci or genes encoding human immunoglobulin sequences (see, e.g., WO98/24893; WO96/34096; WO96/33735; WO91/10741; Jakobovits et al., *Proc. Natl. Acad. Sci. USA* 90: 2551 (1993); Jakobovits et al., *Nature* 362: 255-258 (1993); Bruggemann et al., *Year in Immunol.* 7:33 (1993); U.S. Pat. Nos. 5,545,807; 5,545,806; 5,569,825; 5,625,126; 5,633,425; 5,661,016; Marks et al., *Bio. Technology* 10: 779-783 (1992); Lonberg et al., *Nature* 368: 856-859 (1994); Morrison, *Nature* 368: 812-813 (1994); Fishwild et al., *Nature Biotechnol.* 14: 845-851 (1996); Neuberger, *Nature Biotechnol.* 14: 826 (1996) and Lonberg and Huszar, *Intern. Rev. Immunol.* 13: 65-93 (1995).

The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al., *Proc. Natl. Acad. Sci. USA* 81:6851-6855 (1984)).

"Humanized" forms of non-human (e.g., murine) antibodies are chimeric antibodies that contain minimal sequence derived from non-human immunoglobulin. In one embodiment, a humanized antibody is a human immunoglobulin (recipient antibody) in which residues from a hypervariable region of the recipient are replaced by residues from a hypervariable region of a non-human species (donor antibody) such as mouse, rat, rabbit, or nonhuman primate having the desired specificity, affinity, and/or capacity. In some instances, framework region (FR) residues of the human immunoglobulin are replaced by corresponding non-human residues. Furthermore, humanized antibodies may comprise residues that are not found in the recipient antibody or in the donor antibody. These modifications may be made to further refine antibody performance. In general, a humanized antibody will comprise substantially all of at least one, and typically two, variable domains, in which all or substantially all of the hypervariable loops correspond to those of a non-human immunoglobulin, and all or substantially all of the FRs are those of a human immunoglobulin sequence. The humanized antibody optionally will also comprise at least a portion of an immunoglobulin constant region (Fc), typically that of a human immunoglobulin. For further details, see Jones et al., *Nature* 321:522-525 (1986); Riechmann et al., *Nature* 332:323-329 (1988); and Presta, *Curr. Op. Struct. Biol.* 2:593-596 (1992). See also the following review articles and references cited therein: Vaswani and Hamilton, *Ann. Allergy, Asthma & Immunol.* 1: 105-115 (1998); Harris, *Biochem. Soc. Transactions* 23:1035-1038 (1995); Hurle and Gross, *Curr. Op. Biotech.* 5:428-433 (1994).

A "human antibody" is one which comprises an amino acid sequence corresponding to that of an antibody produced by a human and/or has been made using any of the techniques for making human antibodies as disclosed herein. Such techniques include screening human-derived combinatorial libraries, such as phage display libraries (see, e.g., Marks et al., *J. Mol. Biol.*, 222: 581-597 (1991) and Hoogenboom et al., *Nucl. Acids Res.*, 19: 4133-4137 (1991)); using human myeloma and mouse-human heteromyeloma cell lines for the production of human monoclonal antibodies (see, e.g., Kozbor *J. Immunol.*, 133: 3001 (1984); Brodeur et al., *Monoclonal Antibody Production Techniques and Applications*, pp. 51-63 (Marcel Dekker, Inc., New York, 1987); and Boerner et al., *J. Immunol.*, 147: 86 (1991)); and generating monoclonal antibodies in transgenic animals (e.g., mice) that are capable of producing a full repertoire of human antibodies in the absence of endogenous immunoglobulin production (see, e.g., Jakobovits et al., *Proc. Natl. Acad. Sci. USA*, 90: 2551 (1993); Jakobovits et al., *Nature*, 362: 255 (1993); Bruggermann et al., *Year in Immunol.*, 7: 33 (1993)). This definition of a human antibody specifically excludes a humanized antibody comprising antigen-binding residues from a non-human animal.

An "affinity matured" antibody is one with one or more alterations in one or more CDRs thereof which result in an improvement in the affinity of the antibody for antigen, compared to a parent antibody which does not possess those alteration(s). In one embodiment, an affinity matured antibody has nanomolar or even picomolar affinities for the target antigen. Affinity matured antibodies are produced by procedures known in the art. Marks et al. *Bio/Technology* 10:779-783 (1992) describes affinity maturation by VH and VL domain shuffling. Random mutagenesis of HVR and/or framework residues is described by: Barbas et al. *Proc Nat. Acad. Sci. USA* 91:3809-3813 (1994); Schier et al. *Gene* 169:147-155 (1995); Yelton et al. *J. Immunol.* 155:1994-2004 (1995); Jackson et al., *J. Immunol.* 154(7):3310-9 (1995); and Hawkins et al., *J. Mol. Biol.* 226:889-896 (1992).

A "blocking antibody" or an "antagonist antibody" is one which inhibits or reduces a biological activity of the antigen it binds. Certain blocking antibodies or antagonist antibodies partially or completely inhibit the biological activity of the antigen.

A "small molecule" or "small organic molecule" is defined herein as an organic molecule having a molecular weight below about 500 Daltons.

A "PRO-binding oligopeptide" or an "oligopeptide that binds PRO" is an oligopeptide that is capable of binding PRO with sufficient affinity such that the oligopeptide is useful as a diagnostic and/or therapeutic agent in targeting PRO. In certain embodiments, the extent of binding of a PRO-binding oligopeptide to an unrelated, non-PRO protein is less than about 10% of the binding of the PRO-binding oligopeptide to PRO as measured, e.g., by a surface plasmon resonance assay. In certain embodiments, a PRO-binding oligopeptide has a dissociation constant (Kd) of $\leq 1$ μM, $\leq 100$ μM, $\leq 10$ nM, $\leq 1$ nM, or $\leq 0.1$ nM.

A "PRO-binding organic molecule" or "an organic molecule that binds PRO" is an organic molecule other than an oligopeptide or antibody as defined herein that is capable of binding PRO with sufficient affinity such that the organic molecule is useful as a diagnostic and/or therapeutic agent in targeting PRO. In certain embodiments, the extent of binding of a PRO-binding organic molecule to an unrelated, non-PRO protein is less than about 10% of the binding of the PRO-binding organic molecule to PRO as measured, e.g., by a surface plasmon resonance assay. In certain embodiments, a PRO-binding organic molecule has a dissociation constant (Kd) of $\leq 1$ μM, $\leq 100$ nM, $\leq 10$ nM, $\leq 1$ nM, or $\leq 0.1$ nM.

The dissociation constant (Kd) of any molecule that binds a target polypeptide may conveniently be measured using a surface plasmon resonance assay. Such assays may employ a BIAcore™-2000 or a BIAcore™-3000 (BIAcore, Inc., Piscataway, N.J.) at 25° C. with immobilized target polypeptide CM5 chips at ~10 response units (RU). Briefly, carboxymethylated dextran biosensor chips (CM5, BIAcore Inc.) are activated with N-ethyl-N'-(3-dimethylaminopropyl)-carbodiimide hydrochloride (EDC) and N-hydroxysuccinimide (NHS) according to the supplier's instructions. Target polypeptide is diluted with 10 mM sodium acetate, pH 4.8, to 5 μg/ml (~0.2 μM) before injection at a flow rate of 5 μl/minute to achieve approximately 10 response units (RU) of coupled protein. Following the injection of target polypeptide, 1 M ethanolamine is injected to block unreacted groups. For kinetics measurements, two-fold serial dilutions of the binding molecule (0.78 nM to 500 nM) are injected in PBS with 0.05% Tween 20 (PBST) at 25° C. at a flow rate of approximately 25 μl/min. Association rates ($k_{on}$) and dissociation rates ($k_{off}$) are calculated using a simple one-to-one Langmuir binding model (BIAcore Evaluation Software version 3.2) by simultaneously fitting the association and dissociation sensorgrams. The equilibrium dissociation constant (Kd) is calculated as the ratio $k_{off}/k_{on}$. See, e.g., Chen, Y., et al., (1999) *J. Mol. Biol.* 293:865-881. If the on-rate of an antibody exceeds $10^6$ M$^{-1}$ s$^{-1}$ by the surface plasmon resonance assay above, then the on-rate can be determined by using a fluorescent quenching technique that measures the increase or decrease in fluorescence emission intensity (excitation=295 nm; emission=340 nm, 16 nm band-pass) at 25° C. of a 20 mM antibody (Fab form) in PBS, pH 7.2, in the presence of increasing concentrations of antigen as measured in a spectrometer, such as a stop-flow equipped spectrophotometer (Aviv Instruments) or a 8000-series SLM-Aminco spectrophotometer (ThermoSpectronic) with a stirred cuvette.

A "liposome" is a small vesicle composed of various types of lipids, phospholipids and/or surfactant which is useful for delivery of an agent, e.g., a drug, to a mammal. The components of the liposome are commonly arranged in a bilayer formation, similar to the lipid arrangement of biological membranes.

The word "label" when used herein refers to a detectable compound or composition. The label may be detectable by itself (e.g., radioisotope labels or fluorescent labels) or, in the case of an enzymatic label, may catalyze chemical alteration of a substrate compound or composition which results in a detectable product. Radionuclides that can serve as detectable labels include, for example, I-131, I-123, I-125, Y-90, Re-188, Re-186, At-211, Cu-67, Bi-212, and Pd-109.

An "isolated" biological molecule, such as a nucleic acid, polypeptide, or antibody, is one which has been identified and separated and/or recovered from at least one component of its natural environment.

II. Description of Certain Embodiments

Nucleotide and amino acid variations associated with tumors are provided herein. These variations provide biomarkers for cancer and/or predispose or contribute to tumorigenesis or tumor promotion. Accordingly, the variations disclosed herein are useful in a variety of settings, e.g., in methods and compositions related to cancer diagnosis and therapy.

A. Variations

One hundred-fifty three genes from a panel of 708 tumor specimens were analyzed for variations, as further described in Example A. The variations identified by that analysis are listed in the table shown in FIG. 1. The first column of the table ("VARIANT ID") lists the identification numbers assigned to each variation. The second and third columns ("UNQ ID" and "DNA ID") list additional gene-specific identification numbers. The fourth column ("GENE") lists the genes in which variations were identified. The fifth column ("GENE DESCRIPTION (HUGO)") provides a brief description from the Human Genome Organisation (HUGO) of each gene listed in the fourth column. See Wain et al. (2002) *Genomics* 79:464-470.

The sixth column ("NT_CHGE") lists the nucleotide change found in each gene. In this study, the nucleotide changes were primarily single nucleotide substitutions, although deletions and insertions were also found. The term "HETSUB" in the sixth column stands for "heterozygous substitution," meaning that both the indicated variation and the wild type allele were detected in the tumor sample. The term "HOMSUB" stands for "homozygous substitution," meaning that the indicated variation was detected in the tumor sample, and the wild type allele was not detected in the tumor sample. This may occur, for example, if the tumor has undergone loss of heterozygosity (e.g., where one copy of a given gene contains a variation, and the other copy contains a deletion in the corresponding gene). The term "HOMDEL" (see, e.g., Variant ID 3561 in EGFR) stands for homozygous deletion, meaning that the indicated variation is a deletion that was detected in the tumor sample, and the wild type allele was not detected in the tumor sample. The term "HETDEL" (see, e.g., Variant ID 39041 in EGFR) stands for heterozygous deletion, meaning that the indicated variation is a deletion that was detected in the tumor sample, and the wild type allele was also detected in the tumor sample. The term "HETINS" (see, e.g., Variant ID 60761 in CBLC) stands for heterozygous insertion, meaning that the indicated variation is an insertion that was detected in the tumor sample, and the wild type allele was also detected in the tumor sample.

In the sixth column, nucleotide numbers refer to nucleotide positions in the cDNA sequences corresponding to the indicated genes. For example, in the fifth data row, Variant ID 21270 is a heterozygous substitution designated "505G>T," indicating that a "G" has been substituted by a "T" in one copy of the AKT2 gene, with the substitution occurring at a genomic position corresponding to nucleotide 505 of the cDNA sequence (SEQ ID NO:2) of the AKT2 gene. For each gene listed in FIG. 1, the corresponding cDNA sequences and their translations are provided in the sequence listing, as indicated in Table 1 below.

TABLE 1

| GENE NAME | cDNA SEQUENCE SEQ ID NO | AMINO ACID SEQUENCE SEQ ID NO: |
|---|---|---|
| AKT-1 | 1 | 79 |
| AKT2 | 2 | 80 |
| ALK | 3 | 81 |
| ARAF | 4 | 82 |
| AXIN1 | 5 | 83 |
| AXIN2 | 6 | 84 |
| AXL | 7 | 85 |
| BAX | 8 | 86 |
| BCL-XL | 9 | 87 |
| B-raf | 10 | 88 |
| CBL | 11 | 89 |
| CBLB | 12 | 90 |
| CBLC | 13 | 91 |
| CDKN2A (isoform 1) | 14 | 92 |
| CDKN2A (isoform 2) | 15 | 93 |

TABLE 1-continued

| GENE NAME | cDNA SEQUENCE SEQ ID NO | AMINO ACID SEQUENCE SEQ ID NO: |
|---|---|---|
| CIAS1 (isoform 1) | 16 | 94 |
| CIAS1 (isoform 2) | 17 | 95 |
| cMet | 18 | 96 |
| CXCR4 | 19 | 97 |
| DDR2 | 20 | 98 |
| DUBA2 | 21 | 99 |
| EDG1 | 22 | 100 |
| EGFL11 | 23 | 101 |
| EGFR | 24 | 102 |
| ERBB3 | 25 | 103 |
| ERBB4 | 26 | 104 |
| ETBR | 27 | 105 |
| FGFR1 | 28 | 106 |
| FGFR2 | 29 | 107 |
| FGFR3 | 30 | 108 |
| FGFR4 | 31 | 109 |
| FRAP1 | 32 | 110 |
| GPR73 | 33 | 111 |
| Her2 | 34 | 112 |
| IGF1-R | 35 | 113 |
| JAG1 | 36 | 114 |
| JAG2 | 37 | 115 |
| JAK2 | 38 | 116 |
| KRAS | 39 | 117 |
| MAP2K1 | 40 | 118 |
| MELK | 41 | 119 |
| Notch2 | 42 | 120 |
| NOTCH3 | 43 | 121 |
| NRP1 | 44 | 122 |
| NTC1 | 45 | 123 |
| NTRK1 | 46 | 124 |
| NTRK2 | 47 | 125 |
| NTRK3 | 48 | 126 |
| OTUD1 | 49 | 127 |
| PAK6 | 50 | 128 |
| PDGFRB | 51 | 129 |
| PDK1 | 52 | 130 |
| PIK3CA | 53 | 131 |
| PIK3R1 | 54 | 132 |
| PIK3R2 | 55 | 133 |
| PIK3R4 | 56 | 134 |
| PIK3R5 | 57 | 135 |
| PLK1 | 58 | 136 |
| PRKCB1 | 59 | 137 |
| PRKCI | 60 | 138 |
| PTCH | 61 | 139 |
| PTEN | 62 | 140 |
| RB1 | 63 | 141 |
| Rem2 | 64 | 142 |
| RET | 65 | 143 |
| RON | 66 | 144 |
| SMAD2 | 67 | 145 |
| Stk6 | 68 | 146 |
| SUFU | 69 | 147 |
| TGFBR1 | 70 | 148 |
| TGFBR2 | 71 | 149 |
| TP53 | 72 | 150 |
| USP21 | 73 | 151 |
| USP24 | 74 | 152 |
| USP25 | 75 | 153 |
| USP28 | 76 | 154 |
| USP35 | 77 | 155 |
| VEGFR2 | 78 | 156 |

The seventh column ("AA_CHGE") of the table in FIG. 1 lists the amino acid changes resulting from the nucleotide changes listed in the previous column. Amino acids are numbered according to their positions in the translated cDNA sequences. Where a nucleotide substitution resulted in a stop codon (i.e., a nonsense mutation), the corresponding amino acid change is indicated by an "O" (e.g., see Variant ID 42019 in AXIN1, indicating an amino acid change of "314G>O"). Where a nucleotide change occurred in a splice site, the designation "INTRONIC" occurs in column six (e.g., see Variant ID 3465 in CBL). Where a nucleotide insertion or deletion resulted in a frame shift, the corresponding amino acid change is indicated by "FS" (e.g., see Variant ID 60761 in CBLC).

FIG. 2 provides additional information about the variations reported in FIG. 1. The first and second columns of FIG. 2 list variant identification numbers and corresponding genes, as provided in the first and fourth columns of FIG. 1. The third column ("EFFECT") indicates whether the variation results in a nonsynonymous ("Nonsyn.") or synonymous ("Syn.") amino acid substitution, or a deletion ("Deletion") in the encoded polypeptide. The fourth column ("LOCATION") indicates whether the variation occurs in a coding region ("Coding") or in an intronic region ("Splice Site") of the indicated gene. The fifth column ("DOMAIN") indicates, for some of the variations, the protein domains in which the amino acid changes occur. Protein domains are indicated by Pfam nomenclature. (See, e.g., Bateman et al. (2004) *Nucleic Acids Res.* 32(1):D138-141.) The sixth column indicates the tissue types of the tumors in which the variations were found. The seventh column indicates the particular types of tumors in which the variations were found.

Although the variations described herein were identified in the tumor types indicated in the last column of FIG. 2, other types of cancers may be routinely screened to determine whether any of these variations occur in those cancers. The compositions and methods of the present invention are applicable to any cancer comprising a variation in any PRO or PRO polynucleotide selected from those provided in FIG. 1.

The variations described herein are all somatic mutations (i.e., the variations were present in DNA derived from their respective tumor samples, but absent from DNA derived from the corresponding patient matched normal samples). Generally, somatic mutations are those that occur only in certain tissue(s), e.g., in tumor tissue, and are not inherited in the germline. Germline polymorphisms are generally found in all tissues.

Variations were found in genes encoding proteins from a variety of protein families. For example, variations were found in a number of genes encoding kinases, including receptor tyrosine kinases (RTKs). Generally, activation of kinases is often associated with cell proliferation and tumor promotion. Thus, variations in genes encoding kinases may be "gain-of-function" mutations that increase kinase activity. Tumors in which such variations are detected may thus be responsive to kinase antagonists. A variety of kinase antagonists are currently known in the art. Such kinase antagonists include, but are not limited to antagonist antibodies and small molecule antagonists, e.g., 3-[2,4-dimethylpyrrol-5-yl)methylidene]-indolin-2-one ("SU5416"); imatinib (Gleevec®), a 2-phenylaminopyrimidine; 1-tert-butyl-3-[6-(3,5-dimethoxy-phenyl)-2-(4-diethylamino-butylamino)-pyrido[2,3-d]pyrimidin-7-yl]-urea ("PD173074") (see, e.g., Moffa et al. (2004) *Mol. Cancer Res.* 2:643-652); and indolinones such as 3-[3-(2-carboxyethyl)-4-methylpyrrol-2-methylidenyl]-2-indolinone ("SU5402") (see, e.g., Bernard-Pierrot (2004) *Oncogene* 23:9201-9211).

Variations were also found in tumor suppressor genes (e.g., p53 and retinoblastoma). Generally, loss of tumor suppressor function is often associated with cell proliferation and tumor promotion. Thus, variations in genes encoding tumor suppressors may be complete or partial "loss-of-function" mutations that decrease tumor suppressor function. Tumors in which such variations are detected may be responsive to tumor suppressor agonists. A tumor suppressor agonist may be, e.g., an agonist antibody, a polynucleotide encoding a tumor suppressor, the tumor suppressor itself, or a tumor suppressor-Fc fusion.

B. Compositions

In one aspect, an isolated polynucleotide comprising at least a fragment of a PRO polynucleotide is provided, wherein the fragment comprises a nucleotide variation. In one embodiment, the nucleotide variation is at a nucleotide position selected from FIG. 1. In one such embodiment, the nucleotide variation is a nucleotide change selected from FIG. 1. In another embodiment, a fragment of a PRO polynucleotide is at least about 10 nucleotides in length, alternatively at least about 15 nucleotides in length, alternatively at least about 20 nucleotides in length, alternatively at least about 30 nucleotides in length, alternatively at least about 40 nucleotides in length, alternatively at least about 50 nucleotides in length, alternatively at least about 60 nucleotides in length, alternatively at least about 70 nucleotides in length, alternatively at least about 80 nucleotides in length, alternatively at least about 90 nucleotides in length, alternatively at least about 100 nucleotides in length, alternatively at least about 110 nucleotides in length, alternatively at least about 120 nucleotides in length, alternatively at least about 130 nucleotides in length, alternatively at least about 140 nucleotides in length, alternatively at least about 150 nucleotides in length, alternatively at least about 160 nucleotides in length, alternatively at least about 170 nucleotides in length, alternatively at least about 180 nucleotides in length, alternatively at least about 190 nucleotides in length, alternatively at least about 200 nucleotides in length, alternatively at least about 250 nucleotides in length, alternatively at least about 300 nucleotides in length, alternatively at least about 350 nucleotides in length, alternatively at least about 400 nucleotides in length, alternatively at least about 450 nucleotides in length, alternatively at least about 500 nucleotides in length, alternatively at least about 600 nucleotides in length, alternatively at least about 700 nucleotides in length, alternatively at least about 800 nucleotides in length, alternatively at least about 900 nucleotides in length, alternatively at least about 1000 nucleotides in length, and alternatively about the length of the full-length coding sequence. In this context the term "about" means the referenced nucleotide sequence length plus or minus 10% of that referenced length. In another embodiment, the polynucleotide comprises a nucleotide variation in a polynucleotide sequence selected from SEQ ID NO:1-78 or a fragment thereof. In another embodiment, the complement of any of the above polynucleotides is provided. In another embodiment, a PRO encoded by the any of the above polynucleotides is provided.

In one embodiment, an isolated polynucleotide provided herein is detectably labeled, e.g., with a radioisotope, a fluorescent agent, or a chromogenic agent. In another embodiment, an isolated polynucleotide is a primer. In another embodiment, an isolated polynucleotide is an oligonucleotide, e.g., an allele-specific oligonucleotide. In another embodiment, an oligonucleotide may be, for example, from 7-60 nucleotides in length, 9-45 nucleotides in length, 15-30 nucleotides in length, or 18-25 nucleotides in length. In another embodiment, an oligonucleotide may be, e.g., PNA, morpholino-phosphoramidates, LNA, or 2'-alkoxyalkoxy. Oligonucleotides as provided herein are useful, e.g., as hybridization probes for the detection of nucleotide variations.

In another aspect, an allele-specific oligonucleotide is provided that hybridizes to a region of a PRO polynucleotide comprising a nucleotide variation (e.g., a substitution). In one embodiment, the nucleotide variation is at a nucleotide position selected from FIG. 1. In one such embodiment, the nucleotide variation is a nucleotide change selected from FIG. 1. The allele-specific oligonucleotide, when hybridized to the region of the PRO polynucleotide, comprises a nucleotide that base pairs with the nucleotide variation. In another embodiment, the complement of an allele-specific oligonucleotide is provided. In another embodiment, a microarray comprises an allele-specific oligonucleotide or its complement. In another embodiment, an allele-specific oligonucleotide or its complement is an allele-specific primer.

An allele-specific oligonucleotide can be used in conjunction with a control oligonucleotide that is identical to the allele-specific oligonucleotide, except that the nucleotide that specifically base pairs with the nucleotide variation is replaced with a nucleotide that specifically base pairs with the corresponding nucleotide present in the wild type PRO polynucleotide. Such oligonucleotides may be used in competitive binding assays under hybridization conditions that allow the oligonucleotides to distinguish between a PRO polynucleotide comprising a nucleotide variation and a PRO polynucleotide comprising the corresponding wild type nucleotide. Using routine methods based on, e.g., the length and base composition of the oligonucleotides, one skilled in the art can arrive at suitable hybridization conditions under which (a) an allele-specific oligonucleotide will preferentially bind to a PRO polynucleotide comprising a nucleotide variation relative to a wild type PRO polynucleotide, and (b) the control oligonucleotide will preferentially bind to a wild type PRO polynucleotide relative to a PRO polynucleotide comprising a nucleotide variation. Exemplary conditions include conditions of high stringency, e.g., hybridization conditions of 5× standard saline phosphate EDTA (SSPE) and 0.5% NaDodSO$_4$ (SDS) at 55° C., followed by washing with 2×SSPE and 0.1% SDS at 55° C. or room temperature.

In another aspect, a binding agent is provided that preferentially binds to a PRO comprising an amino acid variation, relative to a wild-type PRO. In one embodiment, the amino acid variation is at an amino acid position selected from FIG. 1. In one such embodiment, the amino acid variation is an amino acid change selected from FIG. 1. In another embodiment, the binding agent is an antibody.

In another aspect, diagnostic kits are provided. In one embodiment, a kit comprises any of the foregoing polynucleotides and an enzyme. In one embodiment, the enzyme is at least one enzyme selected from a nuclease, a ligase, and a polymerase.

C. Methods

In one aspect, a method of detecting the presence of a tumor is provided, the method comprising detecting a variation in a PRO or PRO polynucleotide derived from a biological sample. In one embodiment, the biological sample is obtained from a mammal suspected of having a tumor.

In another aspect, a method of determining the genotype of a biological sample is provided, the method comprising detecting whether a nucleotide variation is present in a PRO polynucleotide derived from the biological sample. In one embodiment, the nucleotide variation is at a nucleotide position selected from FIG. 1. In one such embodiment, the nucleotide variation is a nucleotide change selected from FIG. 1. In another embodiment, the biological sample is suspected of comprising tumor cells. In another embodiment, the biological sample is a cell line, e.g., an immortalized cell line. In another embodiment, the biological sample is a tumor. In one such embodiment, the genotyping of the tumor provides a basis for classifying the tumor.

In another aspect, a method of identifying tumor cells in a biological sample from a mammal is provided, the method comprising detecting a variation in a PRO or PRO polynucleotide derived from the biological sample. In one embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the variation is an amino acid variation. In one such embodiment, the amino acid variation is in a PRO functional domain selected from FIG. 2. In another such embodiment, the amino acid variation is at an amino acid position selected from FIG. 1. In another such embodiment, the amino acid variation is an amino acid change selected from FIG. 1. In another embodiment, the biological sample is a biopsy (e.g., a tissue sample containing cells suspected of being cancerous).

In another aspect, a method of diagnosing a tumor in a mammal is provided, the method comprising detecting the presence of a variation in a PRO or PRO polynucleotide derived from a biological sample obtained from the mammal, wherein the biological sample is known to or suspected of comprising tumor cells. In one embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the variation is an amino acid variation. In one such embodiment, the amino acid variation is in a PRO functional domain selected from FIG. 2. In another such embodiment, the amino acid variation is at an amino acid position selected from FIG. 1. In another such embodiment, the amino acid variation is an amino acid change selected from FIG. 1. In another embodiment, the method is a method of classifying a tumor, e.g., as a tumor characterized by a nucleotide or amino acid variation(s) in a particular PRO polynucleotide or PRO.

In another aspect, a method is provided for predicting whether a tumor from a mammal will respond to a therapeutic agent that targets a PRO or PRO polynucleotide, the method comprising determining whether the tumor comprises a variation in a PRO or PRO polynucleotide, wherein the presence of a variation in a PRO or PRO polynucleotide indicates that the tumor will respond to the therapeutic agent. In one embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the variation is an amino acid variation. In one such embodiment, the amino acid variation is in a PRO functional domain selected from FIG. 2. In another such embodiment, the amino acid variation is at an amino acid position selected from FIG. 1. In another such embodiment, the amino acid variation is an amino acid change selected from FIG. 1. In another embodiment, the PRO is a kinase (such as a tyrosine kinase, e.g., an RTK). In another embodiment, the PRO is a tumor suppressor.

In another aspect, a method of detecting the absence or presence of a nucleotide variation at a nucleotide position in a nucleic acid encoding a PRO is provided, the method comprising (a) contacting the nucleic acid with any of the polynucleotides described above (section II.B.) under conditions suitable for formation of a hybridization complex between the nucleic acid and the polynucleotide; and (b) detecting whether the polynucleotide specifically base pairs with the nucleic acid at the nucleotide position. In one embodiment, the nucleotide variation is at a nucleotide position selected from FIG. 1. In one such embodiment, the nucleotide variation is a nucleotide change selected from FIG. 1.

In another aspect, a method of detecting the absence or presence of a nucleotide variation in a nucleic acid encoding a PRO is provided, the method comprising (a) contacting the nucleic acid with an allele-specific oligonucleotide that is specific for the nucleotide variation under conditions suitable for hybridization of the allele-specific oligonucleotide to the nucleic acid; and (b) detecting the absence or presence of allele-specific hybridization. In one embodiment, the nucleotide variation is at a nucleotide position selected from FIG. 1. In one such embodiment, the nucleotide variation is a nucleotide change selected from FIG. 1. In another embodiment, an allele-specific oligonucleotide is an allele-specific primer.

In another aspect, a method of amplifying a nucleic acid comprising a PRO polynucleotide or fragment thereof is provided, wherein the PRO polynucleotide or fragment thereof comprises a nucleotide variation, the method comprising (a) contacting the nucleic acid with a primer that hybridizes to a sequence 3' of the nucleotide variation, and (b) extending the primer to generate an amplification product comprising the nucleotide variation. In one embodiment, the method further comprises contacting the amplification product with a second primer that hybridizes to a sequence 3' of the nucleotide variation, and extending the second primer to generate a second amplification product. In one such embodiment, the method further comprises amplifying the amplification product and second amplification product, e.g., by PCR. In any of the above embodiments, the nucleotide variation is at a nucleotide position selected from FIG. 1. In any of the above embodiments, the nucleotide variation is a nucleotide change selected from FIG. 1.

In another aspect, a method of assessing the activity of a PRO comprising an amino acid variation is provided, the method comprising (a) determining the activity of the PRO; and (b) comparing the activity of the PRO with the activity of a wild-type PRO. In one embodiment, the activity is kinase activity. In another embodiment, the activity is tumor suppressor activity. In another embodiment, the amino acid variation is in a PRO functional domain selected from FIG. 2. In another embodiment, the amino acid variation is at an amino acid position selected from FIG. 1. In another embodiment, the amino acid variation is an amino acid change selected from FIG. 1.

In another aspect, a method of identifying an agent for the treatment of a tumor is provided, the method comprising (a) contacting a PRO with a test agent, wherein the PRO comprises an amino acid variation, (b) assessing the activity of the PRO in the presence of the test agent with the activity of the PRO in the absence of the test agent, wherein an increase or decrease in the activity of the PRO in the presence of the test agent indicates that the test agent is an agent for the treatment of a tumor. In one embodiment, the amino acid variation is in a PRO functional domain selected from FIG. 2. In another embodiment, the amino acid variation is at an amino acid position selected from FIG. 1. In another embodiment, the amino acid variation is an amino acid change selected from FIG. 1. In another embodiment, the PRO is a kinase (such as a tyrosine kinase, e.g., an RTK), and a decrease in the activity of the kinase in the presence of the test agent indicates that the test agent is an agent for the treatment of a tumor. In another embodiment, the PRO is a tumor suppressor, and an increase in the activity of the tumor suppressor in the presence of the test agent indicates that the test agent is an agent for the treatment of a tumor.

In another aspect, a method of inhibiting the proliferation of a tumor cell is provided, wherein the tumor cell comprises a PRO having an activating variation, the method comprising exposing the tumor cell to an antagonist of PRO. In one embodiment, the PRO is a kinase, e.g., a receptor tyrosine kinase.

In another aspect, a method of inhibiting the proliferation of a tumor cell is provided, wherein the tumor cell comprises a variation in a PRO that decreases the activity of PRO, the method comprising exposing the tumor cell to an agonist of PRO. In one embodiment, an agonist comprises a PRO polynucleotide or PRO itself. In another embodiment, the PRO is a tumor suppressor.

In another aspect, a method of treating a tumor comprising a variation in a PRO is provided, the method comprising administering to a mammal having the tumor an effective amount of a pharmaceutical formulation comprising an antagonist or agonist of PRO. In one embodiment, the variation is a nucleotide variation. In one such embodiment, the nucleotide variation is at a nucleotide position selected from FIG. 1. In one such embodiment, the nucleotide variation is a nucleotide change selected from FIG. 1. In another embodiment, the variation is an amino acid variation. In one such embodiment, the amino acid variation is in a PRO functional domain selected from FIG. 2. In another such embodiment, the amino acid variation is at an amino acid position selected from FIG. 1. In another such embodiment, the amino acid variation is an amino acid change selected from FIG. 1. In another embodiment, the PRO is a kinase (such as a tyrosine kinase, e.g., an RTK). In another embodiment, the PRO is a tumor suppressor.

A tumor, according to any of the above methods, may be a tumor selected from a lung tumor (particularly non-small cell lung carcinomas), breast tumor, colon tumor, kidney tumor, liver tumor, bladder tumor, ovarian tumor, stomach tumor, skin tumor (including melanoma and non-melanoma skin cancers), rectal tumor, and lymphoma. In one embodiment, the tumor is derived from a tissue listed in column 6 of FIG. 2 (e.g., a lung tumor, a colon tumor, a cecum tumor, a liver tumor, a stomach tumor, etc.). In another embodiment, the tumor is selected from the specific tumor types listed in column 7 of FIG. 2.

A nucleotide variation, according to any of the above methods, may be a somatic mutation or a germline polymorphism.

D. General Techniques

Nucleic acid, according to any of the above methods, may be genomic DNA; RNA transcribed from genomic DNA; or cDNA generated from RNA. Nucleic acid may be derived from a vertebrate, e.g., a mammal. A nucleic acid is said to be "derived from" a particular source if it is obtained directly from that source or if it is a copy of a nucleic acid found in that source.

Nucleic acid includes copies of the nucleic acid, e.g., copies that result from amplification. Amplification may be desirable in certain instances, e.g., in order to obtain a desired amount of material for detecting variations. For example, a PRO polynucleotide or portion thereof may be amplified from nucleic acid material. The amplicons may then be subjected to a variation detection method, such as those described below, to determine whether a variation is present in the amplicon.

Variations may be detected by certain methods known to those skilled in the art. Such methods include, but are not limited to, DNA sequencing; primer extension assays, including allele-specific nucleotide incorporation assays and allele-specific primer extension assays (e.g., allele-specific PCR, allele-specific ligation chain reaction (LCR), and gap-LCR); allele-specific oligonucleotide hybridization assays (e.g., oligonucleotide ligation assays); cleavage protection assays in which protection from cleavage agents is used to detect mismatched bases in nucleic acid duplexes; analysis of MutS protein binding; electrophoretic analysis comparing the mobility of variant and wild type nucleic acid molecules; denaturing-gradient gel electrophoresis (DGGE, as in, e.g., Myers et al. (1985) *Nature* 313:495); analysis of RNase cleavage at mismatched base pairs; analysis of chemical or enzymatic cleavage of heteroduplex DNA; mass spectrometry (e.g., MALDI-TOF); genetic bit analysis (GBA); 5' nuclease assays (e.g., TaqMan®); and assays employing molecular beacons. Certain of these methods are discussed in further detail below.

Detection of variations in target nucleic acids may be accomplished by molecular cloning and sequencing of the target nucleic acids using techniques well known in the art. Alternatively, amplification techniques such as the polymerase chain reaction (PCR) can be used to amplify target nucleic acid sequences directly from a genomic DNA preparation from tumor tissue. The nucleic acid sequence of the amplified sequences can then be determined and variations identified therefrom. Amplification techniques are well known in the art, e.g., polymerase chain reaction is described in Saiki et al., *Science* 239:487, 1988; U.S. Pat. Nos. 4,683,203 and 4,683,195.

The ligase chain reaction, which is known in the art, can also be used to amplify target nucleic acid sequences. See, e.g., Wu et al., *Genomics* 4:560-569 (1989). In addition, a technique known as allele-specific PCR can also be used to detect variations (e.g., substitutions). See, e.g., Ruano and Kidd (1989) *Nucleic Acids Research* 17:8392; McClay et al. (2002) *Analytical Biochem.* 301:200-206. In certain embodiments of this technique, an allele-specific primer is used wherein the 3' terminal nucleotide of the primer is complementary to (i.e., capable of specifically base-pairing with) a particular variation in the target nucleic acid. If the particular variation is not present, an amplification product is not observed. Amplification Refractory Mutation System (ARMS) can also be used to detect variations (e.g., substitutions). ARMS is described, e.g., in European Patent Application Publication No. 0332435, and in Newton et al., *Nucleic Acids Research*, 17:7, 1989.

Other methods useful for detecting variations (e.g., substitutions) include, but are not limited to, (1) allele-specific nucleotide incorporation assays, such as single base extension assays (see, e.g., Chen et al. (2000) *Genome Res.* 10:549-557; Fan et al. (2000) *Genome Res.* 10:853-860; Pastinen et al. (1997) *Genome Res.* 7:606-614; and Ye et al. (2001) *Hum. Mut.* 17:305-316); (2) allele-specific primer extension assays (see, e.g., Ye et al. (2001) *Hum. Mut.* 17:305-316; and Shen et al. *Genetic Engineering News*, vol. 23, Mar. 15, 2003), including allele-specific PCR; (3) 5'nuclease assays (see, e.g., De La Vega et al. (2002) *BioTechniques* 32:S48-S54 (describing the TaqMan® assay); Ranade et al. (2001) *Genome Res.* 11: 1262-1268; and Shi (2001) *Clin. Chem.* 47:164-172); (4) assays employing molecular beacons (see, e.g., Tyagi et al. (1998) *Nature Biotech.* 16:49-53; and Mhlanga et al. (2001) *Methods* 25:463-71); and (5) oligonucleotide ligation assays (see, e.g., Grossman et al. (1994) *Nuc. Acids Res.* 22:4527-4534; patent application Publication No. US 2003/0119004 A1; PCT International Publication No. WO 01/92579 A2; and U.S. Pat. No. 6,027,889).

Variations may also be detected by mismatch detection methods. Mismatches are hybridized nucleic acid duplexes which are not 100% complementary. The lack of total complementarity may be due to deletions, insertions, inversions, or substitutions. One example of a mismatch detection method is the Mismatch Repair Detection (MRD) assay described, e.g., in Faham et al., *Proc. Natl. Acad. Sci. USA* 102:14717-14722 (2005) and Faham et al., *Hum. Mol. Genet.* 10: 1657-1664 (2001). Another example of a mismatch cleavage technique is the RNase protection method, which is described in detail in Winter et al., *Proc. Natl. Acad. Sci. USA,* 82:7575, 1985, and Myers et al., *Science* 230:1242, 1985. For example, a method of the invention may involve the use of a labeled riboprobe which is complementary to the human wild-type target nucleic acid. The riboprobe and target nucleic acid derived from the tissue sample are annealed (hybridized) together and subsequently digested with the enzyme RNase A which is able to detect some mismatches in a duplex RNA structure. If a mismatch is detected by RNase A, it cleaves at the site of the mismatch. Thus, when the annealed RNA preparation is separated on an electrophoretic gel matrix, if a mismatch has been detected and cleaved by RNase A, an RNA product will be seen which is smaller than the full-length duplex RNA for the riboprobe and the mRNA or DNA. The riboprobe need not be the full length of the target nucleic acid, but can a portion of the target nucleic acid, provided it encompasses the position suspected of having a variation.

In a similar manner, DNA probes can be used to detect mismatches, for example through enzymatic or chemical cleavage. See, e.g., Cotton et al., *Proc. Natl. Acad. Sci. USA,* 85:4397, 1988; and Shenk et al., *Proc. Natl. Acad. Sci. USA,* 72:989, 1975. Alternatively, mismatches can be detected by shifts in the electrophoretic mobility of mismatched duplexes relative to matched duplexes. See, e.g., Cariello, *Human Genetics,* 42:726, 1988. With either riboprobes or DNA probes, the target nucleic acid suspected of comprising a variation may be amplified before hybridization. Changes in target nucleic acid can also be detected using Southern hybridization, especially if the changes are gross rearrangements, such as deletions and insertions.

Restriction fragment length polymorphism (RFLP) probes for the target nucleic acid or surrounding marker genes can be used to detect variations, e.g., insertions or deletions. Insertions and deletions can also be detected by cloning, sequencing and amplification of a target nucleic acid. Single stranded conformation polymorphism (SSCP) analysis can also be used to detect base change variants of an allele. See, e.g. Orita et al., *Proc. Natl. Acad. Sci. USA* 86:2766-2770, 1989, and *Genomics,* 5:874-879, 1989.

The invention also provides a variety of compositions suitable for use in performing methods of the invention. For example, the invention provides arrays that can be used in such methods. In one embodiment, an array of the invention comprises individual or collections of nucleic acid molecules useful for detecting variations of the invention. For instance, an array of the invention may comprise a series of discretely placed individual allele-specific oligonucleotides or sets of allele-specific oligonucleotides. Several techniques are well-known in the art for attaching nucleic acids to a solid substrate such as a glass slide. One method is to incorporate modified bases or analogs that contain a reactive moiety that is capable of attachment to a solid substrate, such as an amine group, a derivative of an amine group, or another group with a positive charge, into nucleic acid molecules that are synthesized. The synthesized product is then contacted with a solid substrate, such as a glass slide coated with an aldehyde or other reactive group. The aldehyde or other reactive group will form a covalent link with the reactive moiety on the amplified product, which will become covalently attached to the glass slide. Other methods, such as those using amino propryl silican surface chemistry are also known in the art.

A biological sample, according to any of the above methods, may be obtained using certain methods known to those skilled in the art. Biological samples may be obtained from vertebrate animals, and in particular, mammals. Tissue biopsy is often used to obtain a representative piece of tumor tissue. Alternatively, tumor cells can be obtained indirectly in the form of tissues or fluids that are known or thought to contain the tumor cells of interest. For instance, samples of lung cancer lesions may be obtained by resection, bronchoscopy, fine needle aspiration, bronchial brushings, or from sputum, pleural fluid or blood. Variations in target nucleic acids (or encoded polypeptides) may be detected from a tumor sample or from other body samples such as urine, sputum or serum. (Cancer cells are sloughed off from tumors and appear in such body samples.) By screening such body samples, a simple early diagnosis can be achieved for diseases such as cancer. In addition, the progress of therapy can be monitored more easily by testing such body samples for variations in target nucleic acids (or encoded polypeptides). Additionally, methods for enriching a tissue preparation for tumor cells are known in the art. For example, the tissue may be isolated from paraffin or cryostat sections. Cancer cells may also be separated from normal cells by flow cytometry or laser capture microdissection.

III. Examples

A. Identification of Variations in Human Tumors

Seven hundred and eight human tumor specimens were obtained from commercial sources. The tumors were subjected to pathology review to ensure sufficient tumor content (i.e., greater than 80% tumor cells). One hundred fifty-three genes were chosen for analysis based on their potential importance in cancer. PCR was used to amplify exons and some intronic sequences from those genes using genomic DNA obtained from the tumor specimens. Amplicons were sequenced using standard Sanger sequencing, and the sequences were compared with the corresponding wild-type sequences to identify variations. The variations were compared with single nucleotide polymorphisms in the NCBI "dbSNP" database (see Sherry et al. (1999) *Genome Res.* 9:677-679) and with somatic mutations in the Catalogue of Somatic Mutations in Cancer (COSMIC) database (see Bamford et al. (2004) *British Journal of Cancer* 91:355-358) to identify the variations that were not present in those databases and were thus determined to be novel. Variations were validated (i.e., confirmed) by reamplifying and resequencing the exons from the original tumor samples. Amplicons from genomic DNA of patient matched normal samples were generated and sequenced to determine whether the variations were somatic or germline mutations. The results of the foregoing analysis are shown in FIGS. 1 and 2, which are described in further detail in the above Detailed Description of Embodiments.

B. Analysis of Variations

It is noted that somatic mutations were discovered in genes involved in the phosphatidylinositol 3-kinase (PI3K) signaling pathway. Those genes include but are not limited to PIK3R1, PIK3CA, and PTEN. PIK3R1 (also referred to as PI3KR), encodes p85α, which is the regulatory subunit of PI3K. p85α negatively regulates the protein encoded by PIK3CA (referred to as p110α, which is the catalytic subunit of PI3K. Activating mutations in PIK3CA are known to occur frequently in colon and breast cancer. Loss of function mutations in PIK3R1 would therefore be predicted to result in activation of p110α and tumor promotion. PTEN is a tumor suppressor gene that acts downstream of and antagonizes PI3K signaling. Loss of function mutations in PTEN would also be predicted to result in tumor promotion.

The present study identified somatic mutations in PIK3R1 in colon, pancreatic, and breast tumor specimens, as indicated in FIGS. 1 and 2. The positions of some of the mutations found in p85α are graphically depicted in FIG. 3. It is noted that truncation mutations in PIK3R1 have been reported at very low frequency in lymphomas, and splice site mutations in PIK3R1 have been reported at low frequency in primary colon tumors (1/60) and ovarian tumors (3/80). See Philp et al. (2001) *Cancer Res.* 61:7426-7429. However, the present findings provide evidence for mutations in the coding sequence of PIK3R1 in solid tumors (particularly colon tumors) at a frequency of greater than 6%.

The ability of p85α mutants to bind to p110α was assessed. Cos 7 cells were transiently transfected with nucleic acid encoding N-terminally HA-tagged p85α protein (either wild-type or mutant, as indicated in Table 2 below) and with nucleic acid encoding p110α (either wild-type or mutant, as indicated in Table 2 below). Proteins were immunoprecipitated using HA beads, separated by SDS-PAGE, transferred to nitrocellulose, and detected using anti-HA and anti-p110α antibodies. Binding of p85α to p110α is indicated as either "yes" ("Y") or "no" ("N") in Table 2. In the second row of Table 2, the term "p85 Dominant Negative" refers to a known dominant negative form of p85α in which the p110α binding domain from amino acids 479-513 is deleted. The remaining mutant forms of p85α listed in the first column of Table 2 were discovered pursuant to this study. In the header row of Table 2, the terms "p110alpha E545K" and "p110alpha H1047R" refer to two known mutational "hot spots" in p110α which result in constitutively active p110α. The results show that many of the p85α mutants discovered in this study retained the ability to bind wild type and mutant p110α, except for mutants resulting in truncated forms of p85α that lack the p110α binding domain.

TABLE 2

| Enzyme | p110alpha WT | p110alpha E545K | p110alpha H1047R |
|---|---|---|---|
| p85 WT | Y | Y | Y |
| p85 Dominant Negative | N | N | N |
| p85 R162stop | N | N | N |
| p85 R642stop | Y | Y | Y |
| p85 E666K | Y | Y | Y |
| p85 L449S | Y | Y | Y |
| p85 A682V | Y | Y | Y |
| p85 N285H | Y | Y | Y |
| p85 R348stop | N | N | N |
| p85 R649Q | Y | Y | Y |
| p85 N527K | Y | Y | Y |
| p85 N564D | Y | Y | Y |
| p85 R543I | Y | Y | Y |
| p85 R574I | Y | Y | Y |

The ability of p85α mutant proteins to form active complexes with p110α was also assessed. Complexes consisting of p85α protein (either wild-type or mutant, as indicated in Table 3 below) and wild-type p110α were expressed in baculovirus. Activity of p110α in the complexes was assessed using a fluorescence polarization assay with phosphoinositide as the substrate. The assay was conducted in the absence or presence of a phosphotyrosine peptide (referred to as "peptide" in Table 3 below). That peptide corresponds to a phosphotyrosine-containing region of Insulin Receptor Substrate-1 that binds to the SH2 region of p85α and enhances the activity of the wild-type p85α/p110α complex. See Miled et al., *Science*, 317:239-242 (2007). The p85α mutants tested in Table 3 have mutations in their C-terminal SH2 domains. The activity of p110α in the complexes is shown in Table 3. The activities were normalized to the value obtained for p110α in the wild-type complex in the absence of peptide. The results show that one of the p85α mutants ("p85 N564D") resulted in a complex with increased p110α activity in the absence of peptide. Two of the p85α mutants ("p85 R649Q" and "p85 N527K") resulted in complexes with decreased p110α activity in the absence of peptide. One of the p85α mutants ("p85 E666K") resulted in a complex with p110α activity comparable to that seen in the wild type complex. Both wild-type and mutant complexes showed increased p110α activity in the presence of peptide.

TABLE 3

| Enzyme | No peptide | Peptide (1 uM) |
| --- | --- | --- |
| p85 WT | 1 | 2.77 |
| p85 N564D | 1.71 | 2.47 |
| p85 E666K | 0.92 | 2.54 |
| p85 R649Q | 0.45 | 1.7 |
| p85 N527K | 0.75 | 1.92 |

Somatic mutations were also discovered in PIK3CA and PTEN, as indicated in FIGS. 1 and 2. Some of the mutations in PTEN were found in the same tumor specimens as the mutations in PIK3R1. See FIG. 3. Thus, the PI3K pathway may provide multiple targets for tumor diagnosis and therapy.

Additionally, analysis of the frequency of mutations in B-raf, KRAS, PIK3R1, PIK3CA, ERBB3, and ERBB4 reveals that those mutations are predicted to be "driver" mutations, i.e., mutations that play a causative role in tumorigenesis or tumor progression, with statistical significance as follows:

TABLE 4

| Gene | P-value |
| --- | --- |
| B-raf | 0 |
| KRAS | 0 |
| PIK3R1 | 0.003 |
| PIK3CA | 0 |
| ERBB3 | 0.035 |
| ERBB4 | 0.003 |

Figure 4:
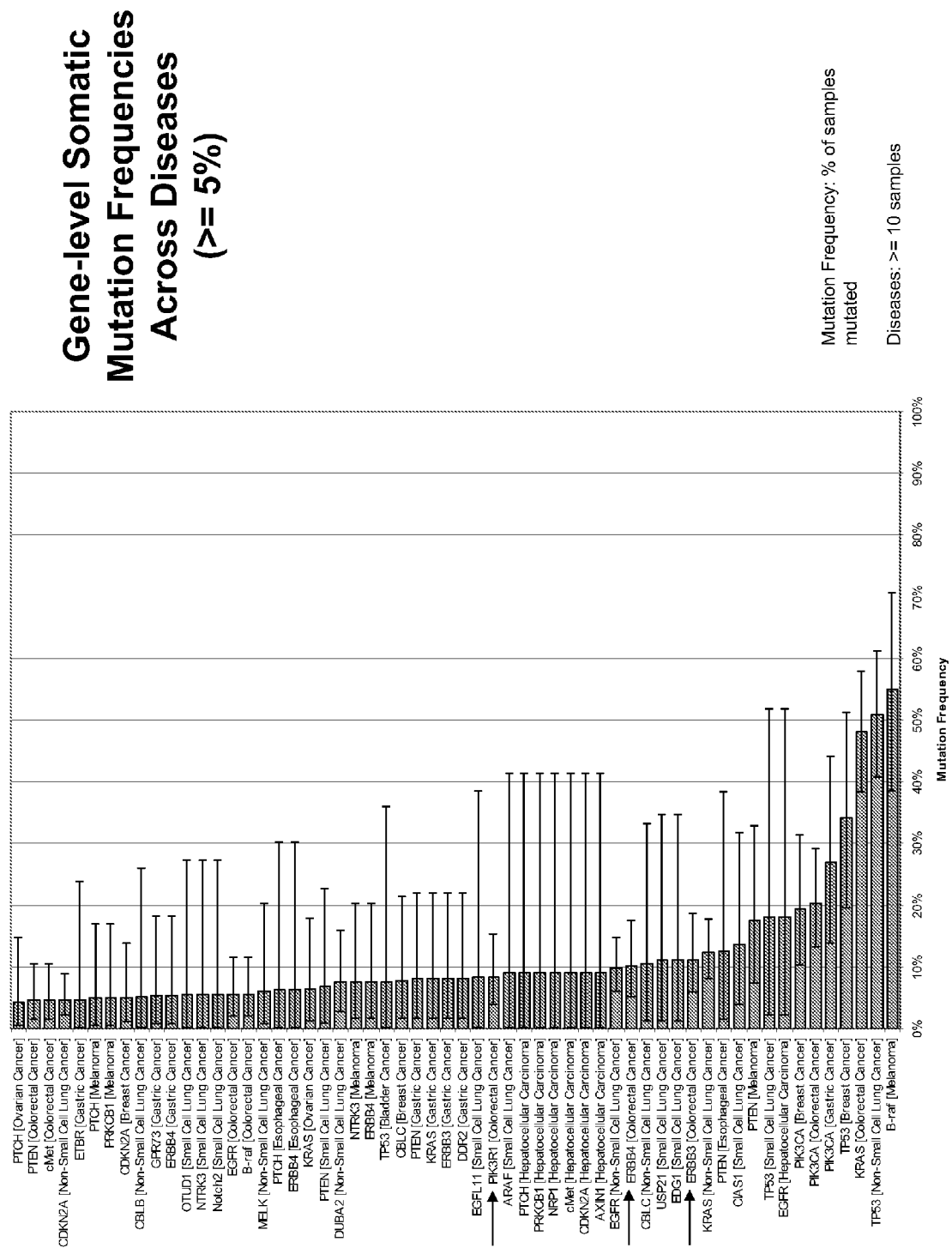
FIG. 4 shows the frequency of somatic mutations in various genes across different types of cancer, as described in Example B.

The frequency of somatic mutations in various genes was also analyzed across different types of cancer. Genes having somatic mutations at a frequency of ≥5% for a particular cancer (≥10 samples) are depicted in FIG. 4. Consistent with the above analysis, arrows show high mutation frequency for PIK3R1, ERBB3, and ERBB4 in colorectal cancer.

Although the foregoing invention has been described in some detail by way of illustration and example for purposes of clarity of understanding, the descriptions and examples should not be construed as limiting the scope of the invention. The disclosures of all patent and scientific literatures cited herein are expressly incorporated in their entirety by reference.

SEQUENCE LISTING (156 sequences)

SEQ ID NO: 1 - DNA, 2610 bp, Homo sapiens
atcctgggacagggcacagggccatctgtcaccaggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggaacgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcagcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctacagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattct

SEQ ID NO: 2 - DNA, 1715 bp, Homo sapiens
gaattccagcggcggcgccgttgccgctgccgggaaacacaaggaaagggaaccagcgcagcgtggcgatgggcgggggtagagccccgccggagaggctgggcggctgccggtgacagactgtgccctgtccacggtgcctcctgcatgtcctgctgccctgagctgtcccgagctaggtgacagcgtaccacgctgccaccatgaatgaggtgtctgtcatcaaagaaggctggctccacaagcgtggtgaatacatcaagacctggaggccacggtacttcctgctgaagagcgacggctccttcattgggtacaaggagaggcccgaggcccctgatcagactctaccccccttaaacaacttctccgtagcagaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcgaaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtgagcagtctgcccacgcagaggacgcacgctcgctgccatcaccgctgggtggttttttacccctgcc

SEQ ID NO: 3 - DNA, 6989 bp, Homo sapiens
aagcgggggcggcagcggtggtagcagctggtacctcccgccgcctctgttcggagggtcgcggggcaccgaggtgctttccggccgccctctggtcggccacccaaagccgcgggcgctgatgatgggtgaggagggggcggcaagatttcgggcgcccctgccctgaacgccctcagctgctgccgccggggccgctccagtgcctgcgaactctgaggagccgaggcgccggtgagagcaaggacgctgcaaacttgcgcagcgcgggggctgggattcacgcccagaagttcagcaggcagacagtccgaagccttcccgcagcggagagatagcttgagggtgcgcaagacggcagcctccgccctcggttcccgcccagaccgggcagaagagcttggaggagccacaaggaacgcaaaaggcggccaggacagcgtgcagcagctgggagccgccgttctcagccttaaaagttgcagagattggaggctgccccgagaggggacagaccccagctccgactgcggggggcaggagaggacggtacccaactgccacctcccttcaaccatagtagttcctctgtaccgagcgcagcgagctacagacgggggcgcggcactcggcgcggagagcgggaggctcaaggtcccagccagtgagcccagtgtgcttgagtgtctctggactcgcccctgagcttccaggtctgtttcatttagactcctgctcgcctccgtgcagttgggggaaagcaagagacttgcgcgcacgcacagtcctctggagatcaggtggaaggagccgctgggtaccaaggactgttcagagcctcttcccatctcggggagagcgaagggtgaggctgggcccggagagcagtgtaaacggcctcctccggcgggatgggagccatcgggctcctgtggctgctgccgctgctgctttccacggcagctgtgggctccgggatggggaccggccagcgcgcgggctccccagctgcggggccgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccttctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggtggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacagggtccacggatccagaaataagcccaccagcttgtggaacccaacgtacggctcctggtttacagagaaacccaccaaaaagaataatcctatagcaaagaaggagccacacgagaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatcaatggctcctttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggccagatgtggttgcataaggtttttatgcatgtttgttgtactctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctgagctcggtcgcacactcacttctcttccttgggatccctaagaccgtggaggagagagaggcaatggctccttcacaaaccagagaccaaatgtcacgttttgttttgtgccaacctattttgaagtaccaccaaaaaagctgtattttgaaaatgctttagaaaggttttgagcatgggttcatcctattctttcgaaagaagaaaatatcataaaaatgagtgataaatacaaggcccagatgtggttgcataaggtttttatgcatgtttgttgtatacttccttatgcttcttttaaattgtgtgtgctctgcttcaatgtagtcagaattagctgcttctatgtttcatagttggggtcatagatgtttccttgccttgttgatgtggacatgagccatttgaggggagagggaacggaaataaaggagttatttgtaatgactaaaa

SEQ ID NO: 4 - DNA, 2466 bp, Homo sapiens
acgtgaccctgacccaataagggtggaaggctgagtccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctctttggctttggggatacttctaaattttgggagctcctccatctccaatggctgggatttgtggcagggattccactcagaacctctctggaatttgtgcctgatgtgccttccactggattttggggttcccagcaccccatgtggattttgggggtcccttttgtgtctcccccgccattcaaggactcctctctttcttcaccaagaagcacagaattc

SEQ ID NO: 5 - DNA, 3477 bp, Homo sapiens
ggtcccgcccgccgcgctgccgctgagcgcatgggcccggaccgcgccgcgccgctccgggagccgggcccggggtcccgccaccaccgcgcgcgggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgcaaaaaaaaaaaaaaaaaaaaaaaaaaaaa

SEQ ID NO: 6 - DNA, 3072 bp, Homo sapiens
acttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgtctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccgggcgtaggccgctatagccctcgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggcttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttgggaagggggagacaggtaagtttt

SEQ ID NO: 7 - DNA, 3081 bp, Homo sapiens
cccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtactctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcaaa

SEQ ID NO: 8 - DNA, 891 bp, Homo sapiens
tcacgtgacccgggcgcgctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttt

SEQ ID NO: 9 - DNA, 2575 bp, Homo sapiens
ggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaaaaaaaaaaaaaaaaaa

SEQ ID NO: 10 - DNA, 2513 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttggaattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtgaaccaaagaaaaaaaaaaaaaaaaaaaaaaaaaaaaaaaaccc

SEQ ID NO: 11 - DNA, 11242 bp, Homo sapiens
cccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcagcggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtgtccttcagttcccacgtagagagagtgtggattatattacatgataacctacctggggaacagtccagaaagctatagaacaagtattttgctggaaatcctaattgaggacttaagacttcctgggttaaggatgtggccgtgtgtgtgtgtgtctgcctgtggttgtatgtgtccttgtgattataagattaacctgctgtgtgtgttaattccaggcagggaattagcacaaaaggtttaggaaggaatctttttttaaagacttccatctactgtggtattatacccaagcctagtgtgtattacaacttcaacactcccctttggcttatattaccatgtgcatagctaaagtcttctatttttagaacaccttctgtctgttctttccccatcaactccttcctcatccttcttggtgttctgtcatgggccatgggcttgctatggccagccttactgaggccaagcagcttatgggatgttctttattgtgtgtgatggtattggtttgtttggtagataagtgggaggaaaagtactgttgctacactattataggcatgtttgatactagcagctaacactggtcactccaaagcactgtttctataggaacattgaagctattaagatgttttgattatcctaattacataatgaccgatttgagatagaggcctttaaatacattccatgccctccccagaaaatagtctgtgggagtcagttgccttggtgccaggtatgtgttctgatgtaggtcatgagtctttctacttaatgggaagggaagaacatttgtttccaggatgactttctggccagaataccggaaagcttttaggaagcttcgttcacatgctatttaaatgcacaaaatagacagtaaggatttatctgttcagtttttcttcccagtgaattaatttcagcttatatgggtgtcttcatttgaacatgaggaatattaggttatattttcagcagtggttttttcctttgccctttaaggagtggggataatgtccacggtggcccagcctcttgctgatggcaccttccctgcattgctgcctcccgatgatgtggttcttttcttgtgcctgtggctttgggaatgtaacatctctttcctcctttccttcccttttcctcttcacctgaggtcctaaatactctctgtaattactgtgttcttcacggtaattagacatcattcagtgaataaattactgtagtcaaagacagtatgggctggcagtttgtgtaattgcaagttcataaagagaattgagggtccagttgggagaactattagtcagttcttttatatgctgataaatgatccctcgagttcagttagtattctgtccagagtgtttagctcactttcttagcagtgtgtaagctttctccatgtcagaagcaagcctgctctttgataaatctgtcttcctgaaaatctaaatcatgcttttgtctttagatctacacagaaatgaccctccttggatcagttttctttccagtctaatcatctttggaactaaaacttgttctaactcgtctcttggcattcagctactcctagatcttttggttttatcccctggcctcagagccatttatattcccagagtaggcagtacaggatctcgtgttgatttgctgtggttacccagtgtcttctctacatggcataaagcggcaaagcccaccattaggtgaggcggtcccgagttgaggtagagtggggcagaggaagatggcagtgaatatcaaacagtagaccgccatcaacttctaacagccagtacacacactgtttcattttgaggtaacgttcagttttgcattttgtttaaatattgaaggcctagacaaagaactagaaaaaaaaaagcagtttccaggcccatccatattgtaatttttctttatctgcagatattgcctgtagtctaaagatctctttggaagacaaagcattggctatatatcttttgccttttccatgcatctaaatcttctctggagattatctccctactgtgtaggttaagggcagtctcgacttttccttttttgagtcctgtgtggctctttgaatcagcgtgaaactgaggctccagctccctgtgttgtgtgtgtgtgccatccatgggcttgggtgtcagtttgtcacaggtatctgccagcattcaaggttttggatcatttcatgaggatctttcctttgactgggtgctgtgaggacacacctgggtctgtgcctgagattgccaggcaagattaaggaaagttttcatgtggcttttgttttgaggttattctcaaaaccttaatttcttatattttctgttgactaaggcaccagtaacccattcttcaccctccatttgtatggcaatttaaaagtctttggctttgctctgaatttaattaaaactgccttttatgaacagacttcgagttttgccattttgggcaagcccttccgcttgtcccttcctagtggctaataaagtaaaaaaacccacactactttgttctctttttctcatattcattgggctgttgtattcagccagtctcatgctttccctgggtcttcacggattgctttccaagctgccttgttgcggggttgctgcagagcagcaactggacctttccagctgtcgccatgttccttccactaaagtagagggttcttaaaatggaaaaacctgtgggctcttcatatacctccctttagttaagtaatagaccaggcagcttctcatctcagcatttacctgttaatatttttgtgaatagtgctctctacctgtgggtggccgttctcttccacttgctcgtctccccccagccccattctgcataatctaccattcttctcctctctttctcttcttatacagaccctcattactggggcccaagatgtgggatactactgttagtattatttaactattttgtagatttaaaagatttctggttaagggaggtgggggtcactgttcatcactcttaaaatatgtgttttctctatagaaaagtaaaatgtgtttatggtcccaaacagtcaactcacaaatttttataacaaaatttccttgtaaaaactagggaccatctatatattccctttaagatctagttctttttgtaggtgttcagcaatggtgataaagcagaatattctcctacctcacgtcattaaagtcagaagattatagaccttctcaaactataagtccctcttcttgccgttggcctttctgactctggaatgaccactgttcattgaaaaatagttttctgactattggtctggctctaacagtttgtttgttcatccagcaaatgtttatgagtgatgaccatgtgccagaaatgtcaggtatgtgtccttcccttggcgccacatagtagtttactaatgtttgggggattgtacttggactgtcatagcctctgcgtttgaccttaaaatagctcttcccagtaagattgtgcaatttttattcacagctcttccatgtagacttacctttcctcatagagctatcctggttaataacaggccaagattctcccattatcccctgttgtctcctgtagctttgataatgcctgggagattccttggtgtaagtgtcatggataccgactgtttttatgttggaatttgttccaacataattagaatctgtttggtgagttgaaaggtaagttggctcagagttgcacagtagggcattaaatgtttaagcaaagcatctgcccacactcccctttccaatctagtgccttccttgaactttttcctgagctgctacgtccctaatcccccttgttgggaggattttcgtatcacccttatgggacctgtcaccatgtcctgtactatttggaattggttttccagtctttcaacaaccgttgtggctaactatgttttagaagggctggaggtgtgggccctgtcttcgggtctcaggacccaaagatcctttagtcagttgttgggtcttccaagagccagacattaatacagattgaactccatcagtcccctaattgtcagcctttacctccctcccagagcaaggagtttagggattctaaagcttagtgtccacacatcattctaccagaccttagagctttagaagctcaatctaaaatactgtaactcagcataaactattactatcactcctttgaactcagtctccatgagcagtgttttgttggaaatacatagaacggcttaatgcctagagggtggtggatagtgaaggacggtcaaggttatatttttgactgcttagggattctttggatccaagaaacagaaatgttcaagcggaataaaggagggagtggagttgtggtaaggatgcagggtatttcgcagaacccaggacgggaagtgcctttggttcttgggtggagctggaactgcagagctttgcacctagtcctttctcccgcttcacagtctgcttatggtatatgtggcccccaaataggcactctagtcctcaagtctacaccaccttccaactctggggatcaccatgaacaaattctcaatttcccatacttaattttttttttttttgagatggagtctcgctgtgtcgcccaggctggagtgcagtggtgcagtctcaactcaccacaacctctgcctcccaggttcaagcagttctctgcctcaacctcccgagtagctgggattacaggcgcctgccaccatgcccagctaatgttcatatttttagtagagacagggtttcaccgtcttggctaggctggtcttgaactcctgaccctcatgatccacccacctcggcctcccaaagtgctaagattacaggcgtgagccaccgcgcccggcccatacttcgtattcttaaaaaaaactacactcagcccagcacattgatcaagtatctatctctgagcagttggccttgccagggagagcagagatgtggcaggctccttcagctggagacagggagcttctcagagaagtgagcagagactccacagacaccctaaaaaggcttctactcaagaagtaaagccactactcctgcctttttgcttagtggacaggaaggcacaggagtttgtctgggacatcatagaaattcttaggtttaacttaattctggtcattgtcttctttatttcctgtttttcttccctttgtcagtcttcgcatccaagatttcttccctccctcttgtgggccagcctgtcctgttccagagctagcctgttcctgggtagccttccttagcctccattcagcctcaggtcttttgccttcttccgtgtttatttagagagcagaatctaataacgggttccactgtagccactatccatggacttctgggtcctcttcaggtttgagtgcttgaaaatgttcattctctgggcttgtggcctgtctcctccactctcctcctcaccctctcgctccttcctgtgtgagggccgctctgcagtaatgttctcaggcaagccttcctaggcacctcagaaactactttgccagagccagtaagaatatataatattggagcagttgccaggatagaaattaaatatagattccagtttaggatagagtttttaccgagagctctttagacagtatacctgtgtcttctctggcaattgctttcattttagtcctatataaaagctttccttttctgtttttttttaaaactatgcttttgcttgcctaaatcttttgatcttatatttctctcatctcagagcctgtcctgagttgtaaggtatttcatactgccttacttaaaagttttttaaactactagagtcatttgatacacacagaagttacctaataatccaaagatgtccatcaagggaggaagggtgggtcatcagactttgcctttgatgttgtagactaggctcctgagttaagcagcagagggacagcagtgccatgtgccttcactgtgtcccaggaaatctgggttggttccagtgggaaataccagtatttcttggttctggaaagtagcaaaagagtaggagatggggaaatagggatggggagagcaagccccgcatgtccatggcgagtcaggtggggagcacgggtggaagggccggctgttgacagacagactaagctgtgtggtgctcttgccgccccttcctgggtacagagcttgagaaaaatgcagccgaccactccctgtgtttgtacagagcaaagcccaaaagccaacctcagatctcctgatttggcagctgaagaaatcagcagagtcctgattgcctgattcagtcccaaaaatgaatgtcaggccccgccccctccccaccaacattgcctctcctacattctccttctgcccctaaatcagacaggaggccagagaggagtattgctcaatgcgtgctatgtgcaactcctcaggccttgtgccacctccatgctgagccctgaagcagggtgtcctgggtgcctgtgtgtcagctccctcctctctacctacctctgaccttcttgtgggtgagggtggccatgcttatggccatcttaaaactggagaggcagagaactacttatgagtctgtagaccacgtgttgtcttccatggcctgtttctcctgctgtctgggtgagtgagcctgcaacgcaatgcccatgagagtaaatgcctcctgacctaccctgctcagcactgttctagtgtcttggccttgaaagaaaagcctgacttcctgctgacacatgtggtaggggcatggcagctatgaggcacctcctacgtctgttttctggctgtggtgacttgggatttttaaccttatatatctttttcctttactcaaaacaaaacaatttttagcacactgaaaaaaaaaaaaagccaaatgttttgtgcctttctaaggcagcactgtatcccaggctgcattttaggacttaatatggaaataccagagtctgagctcctctaccttgagtttcattagtccttagtgtctaggagacaggaaagaatgctctctgtgactggagaggtgacatgcaggtgcagtgtgtctggagtccctttcccctgctgtgagacttcagtggaggagagaagcattgtaccctgggatcatttggttggttccaatcacaagcttagttatcaggttgcatgccttgtctcctgcaaaagacagaatgtttcacaattcccaggtaaactctggaccattccaagtgtcctagccttctgatgacattaattacctagttgtgtcgaggagtataggatggactctcctgagaaggggaggttggtggctttgtcttttctttttgctggatcctgaactggtctagacctcctgcccccaccccccagcccccatcagatgtggctggcctttcatttgaaggcttcagacttaaagcattaagcagctagtgccctctgcagggcctggtttccccagggaagggcagcaaggaacatgggaccagaagcctgtcctcagtaatgtgactatagtgagctttagcaaaagtttttctatataatgacatcttacttatcttttaccctttcctcagttttcccctgcctttaactaataaagaattgggagacagaaattttaaagtcctccttattcaagattttgaaattcttagcctgggagtgctggagagaacctgatgctttctccagaatgaagagtcccaatttgtatatcagtgttaagaagaaaacaaaacaaacacataggtgagattttcgtggactattttaaaaatgtgtcattaatataaaaaatttatattagcagtatttaatcattctcacctgtaaagaataagaaaaacagaaggtaaatattcttacagagaatagcagagctttaagattcattttcattttaagtccattttattttgccagtgtattaatgtttagaagtctgttttactaatgttatttattaattttttttcatttccatacacagttagttaactaaagagctttttcaagcacccatgtctgtaaaaaaatatttttaaataaagtttcttttgttgtagcagaaaaaaaaaaaaaaaa

SEQ ID NO: 12 - DNA, 3976 bp, Homo sapiens
ctgggtcctgtgtgtgccacaggggtggggtgtccagcgagcggtctcctcctcctgctagtgctgctgcggcgtcccgcggcctccccgagtcgggcgggaggggagagcgggtgtggatttgtcttgacggtaattgttgcgtttccacgtctcggaggcctgcgcgctgggttgctccttcttcgggagcgagctgttctcagcgatcccactcccagccggggctccccacacacactgggctgcgtgcgtgtggagtgggacccgcgcacacgcgtgtctctggacagctacggcgccgaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagactgtgccaaaatcccaaacttcagttgaaaaatagcccaccatatatacttgatattttgcctgatacatatcagcatttacgacttatattgagtaaatatgatgacaaccagaaacttgcccaactcagtgagaatgagtactttaaaatctacattgatagccttatgaaaaagtcaaaacgggcaataagactctttaaagaaggcaaggagagaatgtatgaagaacagtcacaggacagacgaaatctcacaaaactgtcccttatcttcagtcacatgctggcagaaatcaaagcaatctttcccaatggtcaattccagggagataactttcgtatcacaaaagcagatgctgctgaattctggagaaagttttttggagacaaaactatcgtaccatggaaagtattcagacagtgccttcatgaggtccaccagattagctctggcctggaagcaatggctctaaaatcaacaattgatttaacttgcaatgattacatttcagtttttgaatttgatatttttaccaggctgtttcagccttggggctctattttgcggaattggaatttcttagctgtgacacatccaggttacatggcatttctcacatatgatgaagttaaagcacgactacagaaatatagcaccaaacccggaagctatattttccggttaagttgcactcgattgggacagtgggccattggctatgtgactggggatgggaatatcttacagaccatacctcataacaagcccttatttcaagccctgattgatggcagcagggaaggattttatctttatcctgatgggaggagttataatcctgatttaactggattatgtgaacctacacctcatgaccatataaaagttacacaggaacaatatgaattatattgtgaaatgggctccacttttcagctctgtaagatttgtgcagagaatgacaaagatgtcaagattgagccttgtgggcatttgatgtgcacctcttgccttacggcatggcaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaagtgcactgacaggcagaactcaccagtcacatcaccaggatcctctccccttgcccagagaagaaagccacagcctgacccactccagatcccacatctaagcctgccacccgtgcctcctcgcctggatctaattcagaaaggcatagttagatctccctgtggcagcccaacgggttcaccaaagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtcttttccaatggtcaccttggaagtgaagaatatgatgttcctccccggctttctcctcctcctccagttaccaccctcctccctagcataaagtgtactggtccgttagcaaattctctttcagagaaaacaagagacccagtagaggaagatgatgatgaatacaagattccttcatcccaccctgtttccctgaattcacaaccatctcattgtcataatgtaaaacctcctgttcggtcttgtgataatggtcactgtatgctgaatggaacacatggtccatcttcagagaagaaatcaaacatccctgacttaagcatatatttaaagggagatgtttttgattcagcctctgatcccgtgccattaccacctgccaggcctccaactcgggacaatccaaagcatggttcttcactcaacaggacgccctctgattatgatcttctcatccctccattaggtgaagatgcttttgatgccctccctccatctctcccacctcccccacctcctgcaaggcatagtctcattgaacattcaaaacctcctggctccagtagccggccatcctcaggacaggatctttttcttcttccttcagatccctttgttgatctagcaagtggccaagttcctttgcctcctgctagaaggttaccaggtgaaaatgtcaaaactaacagaacatcacaggactatgatcagcttccttcatgttcagatggttcacaggcaccagccagaccccctaaaccacgaccgcgcaggactgcaccagaaattcaccacagaaaaccccatgggcctgaggcggcattggaaaatgtcgatgcaaaaattgcaaaactcatgggagagggttatgcctttgaagaggtgaagagagccttagagatagcccagaataatgtcgaagttgcccggagcatcctccgagaatttgccttccctcctccagtatccccacgtctaaatctatagcagccagaactgtagacaccaaaatggaaagcaatcgatgtattccaagagtgtggaaataaagagaactgagatggaattcaagagagaagtgtctcctcctcgtgtagcagcttgagaagaggcttgggagtgcagcttctcaaaggagaccgatgcttgctcaggatgtcgacagctgtggcttccttgtttttgctagccatatttttaaatcagggttgaactgacaaaaataatttaaagacgtttacttcccttgaactttgaacctgtgaaatgctttaccttgtttacagtttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccatgccttgcccaggtccagttccatttctctcattcacaagatgctttgaaggttctgattttcaactgatcaaactaatgcaaaaaaaaaaaagtatgtattcttcactactgagtttcttctttggaaaccatcactattgagagatgggaaaaacctgaatgtataaagcatttatttgtcaataaactgccttttgtaaggggttttcacataacata

SEQ ID NO: 13 - DNA, 1575 bp, Homo sapiens
tcccagccgcaccggtccttcccggcacacgcgaggctcccatggctctggcggtggccccgtgggggcgacagtgggaagaggcccgcgccctgggccgggcagtcaggatgctgcagcgcctagaagagcaatgcgtcgacccccggctgtccgtgagtcccccttcgctgcgggacctgctgccccgcacagcgcagctgcttcgagaggtggcccattctcggcgggcggccggcggaggcggccccgggggtcccggcggctctggggactttctactcatctacctggccaatctggaggccaagagcaggcaggtggccgcgctgctgcctccccggggccgaaggagtgccaacgacgagctcttccgggcgggctccagactcaggcgacagctggccaagctggccatcatcttcagccacatgcacgcagagctgcacgcactcttccccgggggaaagtactgtggacacatgtaccagctcaccaaggcccccgcccacaccttctggagggaaagttgcggagcccggtgtgtgctgccctgggctgagtttgagtccctcctgggcacctgccaccctgtggaaccaggctgcacagccctggccttgcgcaccaccattgacctcacctgcagcgggcacgtgtccatcttcgagttcgacgtcttcaccaggctctttcagccatggccaacactcctcaagaactggcagctcctggcagtcacccacccaggctacatggccttcctcacctatgatgaggtccaagagcgtctgcaggcctgcagagacaagccaggcagttacatcttccggcccagctgtactcgcctggggcagtgggccatcggctatgtgagctcagatggcagcatcctgcagaccatccctgccaacaaacccctgtcccaggtgctcctggagggacagaaggacggcttctacctctacccagatggaaagacccacaacccagacctgactgagctcggccaggcagaaccccagcagcgcatccacgtgtcagaggagcagctgcagctctactgggccatggactccacatttgagctctgcaagatctgtgctgagagcaacaaggatgtgaagattgagccgtgcgggcacctgctctgcagctgctgcctggctgcctggcagcactcggacagccagacctgccccttctgccgctgcgagatcaagggctgggaggccgtgagtatctaccagttctacggtcaggctactgctgaggactcagggaacagcagtgaccaggaaggcagggagttggagctggggcaggtgcccctttcggctcctccattgcccccacggccagatctgccccccaggaagcccagaaatgcccagccgaaagtgagactcctaaaggggaactcccctccagctgcgctgggaccccaggaccctgccccggcctgaaggccagggcacccagatgtgctgctcaagggagccccaagggctggaagggggttgtgaaaccgaaataaactgccaagcctggtctgtcaaaaaaaaaaaaaaaaaa

SEQ ID NO: 14 - DNA, 1154 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 15 - DNA, 1163 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 16 - DNA, 4170 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccccccatagggaaaccttttttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacctcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatatgcctgccttggcctctcaaagtgctgggattacaggcgtgagccactgtgcccggccttggctaacttttcaaaattaaagattttgacttgttacagtcatgtgacatttttttctttctgtttggtgagtttttgataatttatatctctcaaagtggagactttaaaaaagactcatctgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgggaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttt

SEQ ID NO: 17 - DNA, 4484 bp, Homo sapiens
gtagatgaggaaactgaagttgaggaatagtgaagagtttgtccaatgtcatagccccgtaatcaacgggacaaaaattttcttgctgatgggtcaagatggcatcgtgaagtggttgttcaccgtaaactgtaatacaatcctgtttatggatttgtttgcatatttttccctccatagggaaacctttcttccatggctcaggacacactcctggatcgagccaacaggagaactttctggtaagcatttggctaacttttttttttttgagatggagtcttgctgtgtcgcctaggctggagtgcagtggcgtgatcttggctcactgcagcctccacttcccgggttcaatcaattctcctacctcaacttcctgagtagctgggattacaggcgcccgccaccacacccggctcatttttgtacttttagtagagacacagttttgccatgttggccaggctggtcttgaattcctcagctcaggtgatctgcctgccttggcctctcaaagtgctgggattacaggcgtgagccactgtgcccggccttggctaacttttcaaaattaaagattttgacttgttacagtcatgtgacatttttttctttctgtttgctgagtttttgataatttatatctctcaaagtggagactttaaaaaagactcatccgtgtgccgtgttcactgcctggtatcttagtgtggaccgaagcctaaggaccctgaaaacagctgcagatgaagatggcaagcacccgctgcaagctggccaggtacctggaggacctggaggatgtggacttgaagaaatttaagatgcacttagaggactatcctccccagaagggctgcatccccctcccgaggggtcagacagagaaggcagaccatgtggatctagccacgctaatgatcgacttcaatggggaggagaaggcgtgggccatggccgtgtggatcttcgctgcgatcaacaggagagacctttatgagaaagcaaaaagagatgagccgaagtggggttcagataatgcacgtgtttcgaatcccactgtgatatgccaggaagacagcattgaagaggagtggatgggtttactggagtacctttcgagaatctctatttgtaaaatgaagaaagattaccgtaagaagtacagaaagtacgtgagaagcagattccagtgcattgaagacaggaatgcccgtctgggtgagagtgtgagcctcaacaaacgctacacacgactgcgtctcatcaaggagcaccggagccagcaggagagggagcaggagcttctggccatcggcaagaccaagacgtgtgagagccccgtgagtcccattaagatggagttgctgtttgaccccgatgatgagcattctgagcctgtgcacaccgtggtgttccagggggcggcagggattgggaaaacaatcctggccaggaagatgatgttggactgggcgtcggggacactctaccaagacaggtttgactatctgttctatatccactgtcgagaggtgagccttgtgacacagaggagcctgggggacctgatcatgagctgctgccccgacccaaacccacccatccacaagatcgtgagaaaaccctccagaatcctcttcctcatggacggcttcgatgagctgcaaggtgcctttgacgagcacataggaccgctctgcactgactggcagaaggccgagcggggagacattctcctgagcagcctcatcagaaagaagctgcttcccgaggcctctctgctcatcaccacgagacctgtggccctggagaaactgcagcacttgctggaccatcctcggcatgtggagatcctgggtttctccgaggccaaaaggaaagagtacttcttcaagtacttctctgatgaggcccaagccagggcagccttcagtctgattcaggagaacgaggtcctcttcaccatgtgcttcatccccctggtctgctggatcgtgtgcactggactgaaacagcagatggagagtggcaagagccttgcccagacatccaagaccaccaccgcggtgtacgtcttcttcctttccagtttgctgcagccccggggagggagccaggagcacggcctctgcgcccacctctgggggctctgctctttggctgcagatggaatctggaaccagaaaatcctgtttgaggagtccgacctcaggaatcatggactgcagaaggcggatgtgtctgctttcctgaggatgaacctgttccaaaaggaagtggactgcgagaagttctacagcttcatccacatgactttccaggagttctttgccgccatgtactacctgctggaagaggaaaaggaaggaaggacgaacgttccagggagtcgtttgaagcttcccagccgagacgtgacagtccttctggaaaactatggcaaattcgaaaaggggtatttgatttttgttgtacgtttcctctttggcctggtaaaccaggagaggacctcctacttggagaagaaattaagttgcaagatctctcagcaaatcaggctggagctgctgaaatggattgaagtgaaagccaaagctaaaaagctgcagatccagcccagccagctggaattgttctactgtttgtacgagatgcaggaggaggacttcgtgcaaagggccatggactatttccccaagattgagatcaatctctccaccagaatggaccacatggtttcttccttttgcattgagaactgtcatcgggtggagtcactgtccctggggtttctccataacatgcccaaggaggaagaggaggaggaaaaggaaggccgacaccttgatatggtgcagtgtgtcctcccaagctcctctcatgctgcctgttctcatggattggtgaacagccacctcacttccagtttttgccggggcctcttttcagttctgagcaccagccagagtctaactgaattggacctcagtgacaattctctgggggacccagggatgagagtgttgtgtgaaacgctccagcatcctggctgtaacattcggagattgtggttggggcgctgtggcctctcgcatgagtgctgcttcgacatctccttggtcctcagcagcaaccagaagctggtggagctggacctgagtgacaacgccctcggtgacttcggaatcagacttctgtgtgtgggactgaagcacctgttgtgcaatctgaagaagctctggttggtcagctgctgcctcacatcagcatgttgtcaggatcttgcatcagtattgagcaccagccattccctgaccagactctatgtgggggagaatgccttgggagactcaggagtcgcaattttatgtgaaaaagccaagaatccacagtgtaacctgcagaaactggggttggtgaattctggccttacgtcagtctgttgttcagctttgtcctcggtactcagcactaatcagaatctcacgcacctttacctgcgaggcaacactctcggagacaaggggatcaaactactctgtgagggactcttgcaccccgactgcaagcttcaggtgttggaattagacaactgcaacctcacgtcacactgctgctgggatctttccacacttctgacctccagccagagcctgcgaaagctgagcctgggcaacaatgacctgggcgacctgggggtcatgatgttctgtgaagtgctgaaacagcagagctgcctcctgcagaacctggggttgtctgaaatgtatttcaattatgagacaaaaagtgcgttagaaacacttcaagaagaaaagcctgagctgaccgtcgtctttgagccttcttggtaggagtggaaacggggctgccagacgccagtgttctccggtccctccagctgggggccctcaggtggagagagctgcgatccatccaggccaagaccacagctctgtgatccttccggtggagtgtcggagaagagagcttgccgacgatgccttcctgtgcagagcttgggcatctcctttacgccagggtgaggaagacaccaggacaatgacagcatcgggtgttgttgtcatcacagcgcctcagttagaggatgttcctcttggtgacctcatgtaattagctcattcaataaagcactttctttatttttctcttctctgtctaactttctttttcctatcttttttcttctttgttctgtttacttttgctcatatcatcattcccgctatctttctattaactgaccataacacagaactagttgactatatattatgttgaaattttatggcagctatttatttatttaaattttttgtaacagttttgttttctaataagaaaaatccatgctttttgtagctggttgaaaattcaggaatatgtaaaactttttggtatttaattaaattgattccttttcttaattttaaaaaaaaaaaaaaaaaaaaaaaaaaaaa

SEQ ID NO: 18 - DNA, 6641 bp, Homo sapiens
gccctcgccgcccgcggcgccccgagcgctttgtgagcagatgcggagccgagtggagggcgcgagccagatgcggggcgacagctgacttgctgagaggaggcggggaggcgcggagcgcgcgtgtggtccttgcgccgctgacttctccactggttcctgggcaccgaaagataaacctctcataatgaaggcccccgctgtgcttgcacctggcatcctcgtgctcctgtttaccttggtgcagaggagcaatggggagtgtaaagaggcactagcaaagtccgagatgaatgtgaatatgaagtatcagcttcccaacttcaccgcggaaacacccatccagaatgtcattctacatgagcatcacattttccttggtgccactaactacatttatgttttaaatgaggaagaccttcagaaggttgctgagtacaagactgggcctgtgctggaacacccagattgtttcccatgtcaggactgcagcagcaaagccaatttatcaggaggtgtttggaaagataacatcaacatggctctagttgtcgacacctactatgatgatcaactcattagctgtggcagcgtcaacagagggacctgccagcgacatgtctttccccacaatcatactgctgacatacagtcggaggttcactgcatattctccccacagatagaagagcccagccagtgtcctgactgtgtggtgagcgccctgggagccaaagtcctttcatctgtaaaggaccggttcatcaacttctttgtaggcaataccataaattcttcttatttcccagatcatccattgcattcgatatcagtgagaaggctaaaggaaacgaaagatggttttatgtttttgacggaccagtcctacattgatgttttacctgagttcagagattcttaccccattaagtatgtccatgcctttgaaagcaacaattttatttacttcttgacggtccaaagggaaactctagatgctcagacttttcacacaagaataatcaggttctgttccataaactctggattgcattcctacatggaaatgcctctggagtgtattctcacagaaaagagaaaaaagagatccacaaagaaggaagtgtttaatatacttcaggctgcgtatgtcagcaagcctggggcccagcttgctagacaaataggagccagcctgaatgatgacattcttttcggggtgttcgcacaaagcaagccagattctgccgaaccaatggatcgatctgccatgtgtgcattccctatcaaatatgtcaacgacttcttcaacaagatcgtcaacaaaaacaatgtgagatgtctccagcatttttacggacccaatcatgagcactgctttaataggacacttctgagaaattcatcaggctgtgaagcgcgccgtgatgaatatcgaacagagtttaccacagctttgcagcgcgttgacttattcatgggtcaattcagcgaagtcctcttaacatctatatccaccttcattaaaggagacctcaccatagctaatcttgggacatcagagggtcgcttcatgcaggttgtggtttctcgatcaggaccatcaacccctcatgtgaattttctcctggactcccatccagtgtctccagaagtgattgtggagcatacattaaaccaaaatggctacacactggttatcactgggaagaagatcacgaagatcccattgaatggcttgggctgcagacatttccagtcctgcagtcaatgcctctctgccccaccctttgttcagtgtggctggtgccacgacaaatgtgtgcgatcggaggaatgcctgagcgggacatggactcaacagatctgtctgcctgcaatctacaaggttttcccaaatagtgcaccccttgaaggagggacaaggctgaccatatgtggctgggactttggatttcggaggaataataaatttgatttaaagaaaactagagttctccttggaaatgagagctgcaccttgactttaagtgagagcacgatgaatacattgaaatgcacagttggtcctgccatgaataagcatttcaatatgtccataattatttcaaatggccacgggacaacacaatacagtacattctcctatgtggatcctgtaataacaagtatttcgccgaaatacggtcctatggctggtggcactttacttactttaactggaaattacctaaacagtgggaattctagacacatttcaattggtggaaaaacatgtactttaaaaagtgtgtcaaacagtattcttgaatgttataccccagcccaaaccatttcaactgagtttgctgttaaattgaaaattgacttagccaaccgagagacaagcatcttcagttaccgtgaagatcccattgtctatgaaattcatccaaccaaatcttttattagtggtgggagcacaataacaggtgttgggaaaaacctgaattcagttagtgtcccgagaatggtcataaatgtgcatgaagcaggaaggaactttacagtggcatgtcaacatcgctctaattcagagataatctgttgtaccactccttccctgcaacagctgaatctgcaactccccctgaaaaccaaagcctttttcatgttagatgggatcctttccaaatactttgatctcatttatgtacataatcctgtgtttaagccttttgaaaagccagtgatgatctcaatgggcaatgaaaatgtactggaaattaagggaaatgatattgaccctgaagcagttaaaggtgaagtgttaaaagttggaaataagagctgtgagaatatacacttacattctgaagccgttttatgcacggtccccaatgacctgctgaaattgaacagcgagctaaatatagagtggaagcaagcaatttcttcaaccgtccttggaaaagtaatagttcaaccagatcagaatttcacaggattgattgctggtgttgtctcaatatcaacagcactgttattactacttgggtttttcctgtggctgaaaaagagaaagcaaattaaagatctgggcagtgaattagttcgctacgatgcaagagtacacactcctcatttggataggcttgtaagtgcccgaagtgtaagcccaactacagaaatggtttcaaatgaatctgtagactaccgagctacttttccagaagatcagtttcctaattcatctcagaacggttcatgccgacaagtgcagtatcctctgacagacatgtcccccatcctaactagtggggactctgatatatccagtccattactgcaaaatactgtccacattgacctcagtgctctaaatccagagctggtccaggcagtgcagcatgtagtgattgggcccagtagcctgattgtgcatttcaatgaagtcataggaagagggcattttggttgtgtatatcatgggactttgttggacaatgatggcaagaaaattcactgtgctgtgaaatccttgaacagaatcactgacataggagaagtttcccaatttctgaccgagggaatcatcatgaaagattttagtcatcccaatgtcctctcgctcctgggaatctgcctgcgaagtgaagggtctccgctggtggtcctaccatacatgaaacatggagatcttcgaaatttcattcgaaatgagactcataatccaactgtaaaagatcttattggctttggtcttcaagtagccaaaggcatgaaatatcttgcaagcaaaaagtttgtccacagagacttggctgcaagaaactgtatgctggatgaaaaattcacagtcaaggttgctgattttggtcttgccagagacatgtatgataaagaatactatagtgtacacaacaaaacaggtgcaaagctgccagtgaagtggatggctttggaaagtctgcaaactcaaaagtttaccaccaagtcagatgtgtggtcctttggcgtgctcctctgggagctgatgacaagaggagccccaccttatcctgacgtaaacacctttgatataactgtttacttgttgcaagggagaagactcctacaacccgaatactgcccagaccccttatatgaagtaatgctaaaatgctggcaccctaaagccgaaatgcgcccatccttttctgaactggtgtcccggatatcagcgatcttctctactttcattggggagcactatgtccatgtgaacgctacttatgtgaacgtaaaatgtgtcgctccgtatccttctctgttgtcatcagaagataacgctgatgatgaggtggacacacgaccagcctccttctgggagacatcatagtgctagtactatgtcaaagcaacagtccacactttgtccaatggttttttcactgcctgacctttaaaaggccatcgatattctttgctcttgccaaaattgcactattataggacttgtattgttatttaaattactggattctaaggaatttcttatctgacagagcatcagaaccagaggcttggtcccacaggccacggaccaatggcctgcagccgtgacaacactcctgtcatattggagtccaaaacttgaattctgggttgaattttttaaaaatcaggtaccacttgatttcatatgggaaattgaagcaggaaatattgagggcttcttgatcacagaaaactcagaagagatagtaatgctcaggacaggagcggcagccccagaacaggccactcatttagaattctagtgtttcaaaacacttttgtgtgttgtatggtcaataacatttttcattactgatggtgtcattcacccattaggtaaacattcccttttaaatgtttgtttgttttttgagacaggatctcactctgttgccagggctgtagtgcagtggtgtgatcatagctcactgcaacctccacctcccaggctcaagcctcccgaatagctgggactacaggcgcacaccaccatccccggctaatttttgtattttttgtagagacggggttttgccatgttgccaaggctggtttcaaactcctggactcaagaaatccacccacctcagcctcccaaagtgctaggattacaggcatgagccactgcgcccagcccttataaatttttgtatagacattcctttggttggaagaatatttataggcaatacagtcaaagtttcaaaatagcatcacacaaaacatgtttataaatgaacaggatgtaatgtacatagatgacattaagaaaatttgtatgaaataatttagtcatcatgaaatatttagttgtcatataaaaacccactgtttgagaatgatgctactctgatctaatgaatgtgaacatgtagatgttttgtgtgtatttttttaaatgaaaactcaaaataagacaagtaatttgttgataaatatttttaaagataactcagcatgtttgtaaagcaggatacattttactaaaaggttcattggttccaatcacagctcataggtagagcaaagaaagggtggatggattgaaaagattagcctctgtctcggtggcaggttcccacctcgcaagcaattggaaacaaaacttttggggagttttattttgcattagggtgtgttttatgttaagcaaaacatactttagaaacaaatgaaaaaggcaattgaaaatcccagctatttcacctagatggaatagccaccctgagcagaactttgtgatgcttcattctgtggaattttgtgcttgctactgtatagtgcatgtggtgtaggttactctaactggttttgtcgacgtaaacatttaaagtgttatattttttataaaaatgtttatttttaatgatatgagaaaaattttgttaggccacaaaaacactgcactgtgaacattttagaaaaggtatgtcagactgggattaatgacagcatgattttcaatgactgtaaattgcgataaggaaatgtactgattgccaatacaccccaccctcattacatcatcaggacttgaagccaagggttaacccagcaagctacaaagagggtgtgtcacactgaaactcaatagttgagtttggctgttgttgcaggaaaatgattataactaaaagctctctgatagtgcagagacttaccagaagacacaaggaattgtactgaagagctattacaatccaaatattgccgtttcataaatgtaataagtaatactaattcacagagtattgtaaatggtggatgacaaaagaaaatctgctctgtggaaagaaagaactgtctctaccagggtcaagagcatgaacgcatcaatagaaagaactcggggaaacatcccatcaacaggactacacacttgtatatacattcttgagaacactgcaatgtgaaaatcacgtttgctatttataaacttgtccttagattaatgtgtctggacagattgtgggagtaagtgattcttctaagaattagatacttgtcactgcctatacctgcagctgaactgaatggtacttcgtatgttaatagttgttctgataaatcatgcaattaaagtaaagtgatgcaacatcttgtaaaaaaaaaaaaaaaaaaaa

SEQ ID NO: 19 - DNA, 1679 bp, Homo sapiens
gtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatg

SEQ ID NO: 20 - DNA, 3086 bp, Homo sapiens
aacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatactttttttttttttacattaaagaactaaaaaaaaaaaaaaaaaaaaaaaaaaaaaaaaaaaaaaaaaaaaaaaaaaaaaaaaaaaaaaaaaaaa

SEQ ID NO: 21 - DNA, 1689 bp, Homo sapiens
agcaaatttcaactcccgcttgccattcaacatcatggatgatccgaagagtgaacagcagcgcatactgcgccgccaccaacgcgagaggcaggagctgcaggcccagatccggagcttaaaaaactcggtccccaagaccgacaagacgaaaagaaagcagttgctccaagacgtggcccgcatggaggccgagatggctcagaagcaccggcaggagctggagaagttccaagacgacagtagcattgaatctgtcgtcgaagacctggccaagatgaatctggaaaaccggcctccccgctcctccaaagcccacagaaagagagaaagaatggagtccgaggagagggagcgccaggagagcatcttccaggctgagatgtcggagcacctggccggcttcaagcgcgaggaggaggagaagctcgccgccatcctgggagccaggggtctggagatgaaagcgatcccggccgacggccactgcatgtaccgcgccatccaagaccagctggtgttcagcgtgtctgtggagatgctgcgctgccgcaccgccagctacatgaagaagcacgtcgacgagttcctgcccttcttcagcaaccccgagaccagcgactccttcggctacgacgacttcatgatctactgcgacaacatcgtgcgcaccacggcatggggaggccagctggagctgagggccctgtcgcacgtcctgaagacccccatcgaggtgatccaggccgactcgcccaccttgatcatcggggaggagtacgtcaagaagccgatcatcctggtctacctgcgctatgcctacagcctcggcgagcactacaactccgtgacaccgctcgaggccggcgccgccgggggcgtgctcccgcgtctcctgtaggccccaaggcgctgagcagccccgggaaactgtcgccgtcgccgcatctcctcagtaggctcagtttattttccccttttgcttttctctgtttttcttttccttccttttaatcaaaactacccgcccccgccccgcccccgctttcctaaccttgctgctttcacagggtgggaaacgaaattcgagggaaattccccggaaatatgagggaaatctctgcattgcaccaccagaggggcataaatttgaaagttctaacctcttcttgcccttaagggtcttttacctccctcaccaactaagatttggtcatgttgcgtataacttcaccacaaaaatggaaatattggccgggcgcggtggctcacgcctgtaatcccagcactttgggaggccgaggcgggcggatcacgaggtcaggagttcgagaccagcctggccaacatggtgaaaccccacctctacaaaaaatacaaaaattagccgggcgtggtggcaggcacctgtagtcccagatactcgggaggctaaggcaggagaatcgcttgacgggaagcggaggttgcagtgagccgagatcgtgcctttgcactccagcgtggaagacagtgagactccgtctcaaaaaaatgaaaaattagccaggcaggttggcgggggcctgtaatcctagctacttggggtgctgaggcaggagaatcaactgaacccgggaggcggaggctgcagtgggccgggatcatactactgcactccagcatggaagacagcgagactccgtctcc

SEQ ID NO: 22 - DNA, 2655 bp, Homo sapiens
gaattcggcacgaggcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaagaaaaaaaaaaaaaaaaaaaaaaaaaaaaaaaaaaaaaaaaaaaaaaaaaaaaaaaaaaaaaaaactcgac

SEQ ID NO: 23 - DNA, 2245 bp, Homo sapiens
caaaattcatatgttgcaacatttacccttagtgtgactatatttggagatagggcttttaggaggtgttttttgaaaactaatcagaagaggaatgcttatctcccaagaaaattgaaaccatctgtaaaagaatcttggctgtgctgtgttttgattagattgaagcttggtgtaaagagaaaacacaaaagaccgcagaatatttacaacatttgaattcctgtttctccatcaaagcacattgtcatcaaagctactttgggtatagaaaaaaggtcaattccaattcccaggaatccttaaccacaactttacttggaaatttccggtaatacttaaaacaccattttgcagcaattctttatgataaactgtaaaatacagctacccgaaaatgactgacaaatcaatcgtcattctgagcctgatggtttttcacagctctttcataaatggaaaaacatgtagacggcaattggtggaagaatggcatccacaaccctcatcatatgtggtaaattggacactaacagaaaacatctgcttggacttctacagagattgctggtttttgggtgtaaacactaaaatagatacttcaggcaatcaagctgttccccagatttgccctttgcaaattcaattaggagatatccttgtaatttcttctgaaccatctcttcaatttccagaaataaatttgatgaatgtttctgaaacatctttcgttggctgtgtgcaaaataccacaacggaagatcagttactttttggctgcagactaaaaggaatgcacactgttaattctaagtggctgagtgttgggacacattattttatcacagttatggcaagtggtccatcaccttgtccactgggacttcgactaaatgtgacagtgaaacagcagttctgccaggaatctctgagttcagaattttgctctggtcatggtaaatgtcttagtgaagcttggagcaagacatatagctgccattgccagcctccattttctggaaaatactgccaggaacttgatgcatgttcttttaaaccatgtaaaaataatggcagttgcattaataaaagagaaaattgggatgagcaagcatatgaatgtgtctgtcacccaccatttacaggaaagaattgctcagaaataattggccagtgtcaaccacatgtctgtttccatggaaactgcagcaatattacttcaaatagtttcatttgtgaatgtgatgagcaattttcaggtccattctgtgaggtgtcagcaaaaccttgtgtttctctgcttttttggaaaagaggaatttgcccaaatagcagttctgcttatacttatgaatgcccaaaaggatcttccagccaaaatggtgaaactgatgtcagtgagttttcattagtaccatgtcagaatggtactgactgcatcaaaatatcaaatgatgttatgtgcatctgttcaccaatatttacagatttgctttgtaagagcattcaaacatcatgtgagtcatttcctttgaggaataatgctacatgtaagaaatgtgagaaagattatccttgcagctgtatatcaggatttactgaaaaaaactgtgagaaagcaattgaccactgtaaactgctcagcatcaactgtctgaatgaagaatggtgtttcaatataattggaagattcaaatatgtatgcattccagggtgcacaaaaaatccatgttggtttttgaagaatgtttacctaattcatcaacacctctgctactgtggagtcaccttccatggtatttgccaagataaaggtcctgctcaatttgaatatgtgtggcaattgggatttgcaggatctgaaggcgaaaagtgccaaggggttattgatgcctatttctttctggctgcaaactgcactgaagatgcaacctatgtgaacgatcctgaagataataattcttcatgttggttcccacatgaaggcacaaaagagatttgtgcaaatggatgcagttgtttgagtgaagaagacagtcaggaatatcggtatctatgttttctcagatgggctggcaacatgtatctggaaaatacaactgatgatcaagaaaatgagtgtcaacatgaagctgtttgtaaagatgaaattaatagacccaggtatttatgtatcatttgagcagataatatcacatatcaaaaagttataattaaattgatagtcatcaaaaaaaaaaaaaaa

SEQ ID NO: 24 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 25 - DNA, 5511 bp, Homo sapiens
acacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatcca

SEQ ID NO: 26 - DNA, 5484 bp, Homo sapiens
aattgtcagcacgggatctgagacttccaaaaaatgaagccggcgacaggactttgggtctgggtgagccttctcgtggcggcggggaccgtccagcccagcgattctcagtcagtgtgtgcaggaacggagaataaactgagctctctctctgacctggaacagcagtaccgagccttgcgcaagtactatgaaaactgtgaggttgtcatgggcaacctggagataaccagcattgagcacaaccgggacctctccttcctgcggtctgttcgagaagtcacaggctacgtgttagtggctcttaatcagtttcgttacctgcctctggagaatttacgcattattcgtgggacaaaactttatgaggatcgatatgccttggcaatatttttaaactacagaaaagatggaaactttggacttcaagaacttggattaaagaacttgacagaaatcctaaatggtggagtctatgtagaccagaacaaattcctttgttatgcagacaccattcattggcaagatattgttcggaacccatggccttccaacttgactcttgtgtcaacaaatggtagttcaggatgtggacgttgccataagtcctgtactggccgttgctggggacccacagaaaatcattgccagactttgacaaggacggtgtgtgcagaacaatgtgacggcagatgctacggaccttacgtcagtgactgctgccatcgagaatgtgctggaggctgctcaggacctaaggacacagactgctttgcctgcatgaatttcaatgacagtggagcatgtgttactcagtgtccccaaacctttgtctacaatccaaccacctttcaactggagcacaatttcaatgcaaagtacacatatggagcattctgtgtcaagaaatgtccacataactttgtggtagattccagttcttgtgtgcgtgcctgccctagttccaagatggaagtagaagaaaatgggattaaaatgtgtaaaccttgcactgacatttgcccaaaagcttgtgatggcattggcacaggatcattgatgtcagctcagactgtggattccagtaacattgacaaattcataaactgtaccaagatcaatgggaatttgatctttctagtcactggtattcatggggacccttacaatgcaattgaagccatagacccagagaaactgaacgtctttcggacagtcagagagataacaggtttcctgaacatacagtcatggccaccaaacatgactgacttcagtgttttttctaacctggtgaccattggtggaagagtactctatagtggcctgtccttgcttatcctcaagcaacagggcatcacctctctacagttccagtccctgaaggaaatcagcgcaggaaacatctatattactgacaacagcaacctgtgttattatcataccattaactggacaacactcttcagcacaatcaaccagagaatagtaatccgggacaacagaaaagctgaaaattgtactgctgaaggaatggtgtgcaaccatctgtgttccagtgatggctgttggggacctgggccagaccaatgtctgtcgtgtcgccgcttcagtagaggaaggatctgcatagagtcttgtaacctctatgatggtgaatttcgggagtttgagaatggctccatctgtgtggagtgtgacccccagtgtgagaagatggaagatggcctcctcacatgccatggaccgggtcctgacaactgtacaaagtgctctcattttaaagatggcccaaactgtgtggaaaaatgtccagatggcttacagggggcaaacagtttcattttcaagtatgctgatccagatcgggagtgccacccatgccatccaaactgcacccaagggtgtaacggtcccactagtcatgactgcatttactacccatggacgggccattccactttaccacaacatgctagaactcccctgattgcagctggagtaattggtgggctcttcattctggtcattgtgggtctgacatttgctgtttatgttagaaggaagagcatcaaaaagaaaagagccttgagaagattcttggaaacagagttggtggaaccattaactcccagtggcacagcacccaatcaagctcaacttcgtattttgaaagaaactgagctgaagagggtaaaagtccttggctcaggtgcttttggaacggtttataaaggtatttgggtacctgaaggagaaactgtgaagattcctgtggctattaagattcttaatgagacaactggtcccaaggcaaatgtggagttcatggatgaagctctgatcatggcaagtatggatcatccacacctagtccggttgctgggtgtgtgtctgagcccaaccatccagctggttactcaacttatgccccatggctgcctgttggagtatgtccacgagcacaaggataacattggatcacaactgctgcttaactggtgtgtccagatagctaagggaatgatgtacctggaagaaagacgactcgttcatcgggatttggcagcccgtaatgtcttagtgaaatctccaaaccatgtgaaaatcacagattttgggctagccagactcttggaaggagatgaaaaagagtacaatgctgatggaggaaagatgccaattaaatggatggctctggagtgtatacattacaggaaattcacccatcagagtgacgtttggagctatggagttactatatgggaactgatgacctttggaggaaaaccctatgatggaattccaacgcgagaaatccctgatttattagagaaaggagaacgtttgcctcagcctcccatctgcactattgacgtttacatggtcatggtcaaatgttggatgattgatgctgacagtagacctaaatttaaggaactggctgctgagttttcaaggatggctcgagaccctcaaagatacctagttattcagggtgatgatcgtatgaagcttcccagtccaaatgacagcaagttctttcagaatctcttggatgaagaggatttggaagatatgatggatgctgaggagtacttggtccctcaggctttcaacatcccacctcccatctatacttccagagcaagaattgactcgaataggagtgaaattggacacagccctcctcctgcctacacccccatgtcaggaaaccagtttgtataccgagatggaggttttgctgctgaacaaggagtgtctgtgccctacagagccccaactagcacaattccagaagctcctgtggcacagggtgctactgctgagatttttgatgactcctgctgtaatggcaccctacgcaagccagtggcaccccatgtccaagaggacagtagcacccagaggtacagtgctgaccccaccgtgtttgccccagaacggagcccacgaggagagctggatgaggaaggttacatgactcctatgcgagacaaacccaaacaagaatacctgaatccagtggaggagaacccttttgtttctcggagaaaaaatggagaccttcaagcattggataatcccgaatatcacaatgcatccaatggtccacccaaggccgaggatgagtatgtgaatgagccactgtacctcaacacctttgccaacaccttgggaaaagctgagtacctgaagaacaacatactgtcaatgccagagaaggccaagaaagcgtttgacaaccctgactactggaaccacagcctgccacctcggagcacccttcagcacccagactacctgcaggagtacagcacaaaatatttttataaacagaatgggcggatccggcctattgtggcagagaatcctgaatacctctctgagttctccctgaagccaggcactgtgctgccgcctccaccttacagacaccggaatactgtggtgtaagctcagttgtggttttttaggtggagagacacacctgctccaatttccccacccccctctctttctctggtggtcttccttctaccccaaggccagtagttttgacacttcccagtggaagatacagagatgcaatgatagttatgtgcttacctaacttgaacattagagggaaagactgaaagagaaagataggaggaaccacaatgtttcttcatttctctgcatgggttggtcaggagaatgaaacagctagagaaggaccagaaaatgtaaggcaatgctgcctactatcaaactagctgtcactttttttctttttctttttctttctttgtttctttcttcctcttctttttttttttttttttaaagcagatggttgaaacacccatgctatctgttcctatctgcaggaactgatgtgtgcatatttagcatccctggaaatcataataaagtttccattagaacaaaagaataacattttctataacatatgatagtgtctgaaattgagaatccagtttctttccccagcagtttctgtcctagcaagtaagaatggccaactcaactttcataatttaaaaatctccattaaagttataactagtaattatgttttcaacactttttggtttttttcattttgttttgctctgaccgattcctttatatttgctcccctatttttggctttaatttctaattgcaaagatgtttacatcaaagcttcttcacagaatttaagcaagaaatattttaatatagtgaaatggccactactttaagtatacaatctttaaaataagaaagggaggctaatatttttcatgctatcaaattatcttcaccctcatcctttacatttttcaacatttttttttctccataaatgacactacttgataggccgttggttgtctgaagagtagaagggaaactaagagacagttctctgtggttcaggaaaactactgatactttcaggggtggcccaatgagggaatccattgaactggaagaaacacactggattgggtatgtctacctggcagatactcagaaatgtagtttgcacttaagctgtaattttatttgttctttttctgaactccattttggattttgaatcaagcaatatggaagcaaccagcaaattaactaatttaagtacatttttaaaaaaagagctaagataaagactgtggaaatgccaaaccaagcaaattaggaaccttgcaacggtatccagggactatgatgagaggccagcacattatcttcatatgtcacctttgctacgcaaggaaatttgttcagttcgtatacttcgtaagaaggaatgcgagtaaggattggcttgaattccatggaatttctagtatgagactatttatatgaagtagaaggtaactctttgcacataaattggtataataaaaagaaaaacacaaacattcaaagcttagggataggtccttgggtcaaaagttgtaaataaatgtgaaacatcttctc

SEQ ID NO: 27 - DNA, 4286 bp, Homo sapiens
gagacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcgcagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttttttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 28 - DNA, 4049 bp, Homo sapiens
cctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcaggcgcacggtacccgtgctgcagtcgggcacgccgcggcgccgggggcctccgcagggcgatggagccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaac

SEQ ID NO: 29 - DNA, 4587 bp, Homo sapiens
gagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgattctcttcagtgaattttgataatggcttccagactctttgcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttaaaaaaaaaaaaaaaa

SEQ ID NO: 30 - DNA, 4093 bp, Homo sapiens
cgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaacggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacaaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagccctccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggaccccgtggggcagggagctgggcccgacatggctcggcctctgcctttgcaccacgggacatcacagggtgcgctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccaggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttgctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctgaaaaaaaaaaaaaaaaaaaaaaaaaaaaaa

SEQ ID NO: 31 - DNA, 3040 bp, Homo sapiens
ctcgctcccggccgaggagcgctcgggctgtctgcggaccctgccgcgtgcaggggtcgcggccggctggagctgggagtgaggcggcggaggagccaggtgaggaggagccaggaaggcagttggtgggaagtccagcttgggtccctgagagctgtgagaaggagatgcggctgctgctggccctgttgggggtcctgctgagtgtgcctgggcctccagtcttgtccctggaggcctctgaggaagtggagcttgagccctgcctggctcccagcctggagcagcaagagcaggagctgacagtagcccttgggcagcctgtgcgtctgtgctgtgggcgggctgagcgtggtggccactggtacaaggagggcagtcgcctggcacctgctggccgtgtacggggctggaggggccgcctagagattgccagcttcctacctgaggatgctggccgctacctctgcctggcacgaggctccatgatcgtcctgcagaatctcaccttgattacaggtgactccttgacctccagcaacgatgatgaggaccccaagtcccatagggacccctcgaataggcacagttacccccagcaagcaccctactggacacacccccagcgcatggagaagaaactgcatgcagtacctgcggggaacaccgtcaagttccgctgtccagctgcaggcaaccccacgcccaccatccgctggcttaaggatggacaggcctttcatggggagaaccgcattggaggcattcggctgcgccatcagcactggagtctcgtgatggagagcgtggtgccctcggaccgcggcacatacacctgcctggtagagaacgctgtgggcagcatccgctataactacctgctagatgtgctggagcggtccccgcaccggcccatcctgcaggccgggctcccggccaacaccacagccgtggtgggcagcgacgtggagctgctgtgcaaggtgtacagcgatgcccagccccacatccagtggctgaagcacatcgtcatcaacggcagcagcttcggagccgacggtttcccctatgtgcaagtcctaaagactgcagacatcaatagctcagaggtggaggtcctgtacctgcggaacgtgtcagccgaggacgcaggcgagtacacctgcctcgcaggcaattccatcggcctctcctaccagtctgcctggctcacggtgctgccagaggaggaccccacatggaccgcagcagcgcccgaggccaggtatacggacatcatcctgtacgcgtcgggctccctggccttggctgtgctcctgctgctggccgggctgtatcgagggcaggcgctccacggccggcacccccgcccgcccgccactgtgcagaagctctcccgcttccctctggcccgacagttctccctggagtcaggctcttccggcaagtcaagctcatccctggtacgaggcgtgcgtctctcctccagcggccccgccttgctcgccggcctcgtgagtctagatctacctctcgacccactatgggagttcccccgggacaggctggtgcttgggaagcccctaggcgagggctgctttggccaggtagtacgtgcagaggcctttggcatggaccctgcccggcctgaccaagccagcactgtggccgtcaagatgctcaaagacaacgcctctgacaaggacctggccgacctggtctcggagatggaggtgatgaagctgatcggccgacacaagaacatcatcaacctgcttggtgtctgcacccaggaagggcccctgtacgtgatcgtggagtgcgccgccaagggaaacctgcgggagttcctgcgggcccggcgccccccaggccccgacctcagccccgacggtcctcggagcagtgaggggccgctctccttcccagtcctggtctcctgcgcctaccaggtggcccgaggcatgcagtatctggagtcccggaagtgtatccaccgggacctggctgcccgcaatgtgctggtgactgaggacaatgtgatgaagattgctgactttgggctggcccgcggcgtccaccacattgactactataagaaaaccagcaacggccgcctgcctgtgaagtggatggcgcccgaggccttgtttgaccgggtgtacacacaccagagtgacgtgtggtcttttgggatcctgctatgggagatcttcaccctcgggggctccccgtatcctggcatcccggtggaggagctgttctcgctgctgcgggagggacatcggatggaccgacccccacactgccccccagagctgtacgggctgatgcgtgagtgctggcacgcagcgccctcccagaggcctaccttcaagcagctggtggaggcgctggacaaggtcctgctggccgtctctgaggagtacctcgacctccgcctgaccttcggaccctattccccctctggtggggacgccagcagcacctgctcctccagcgattctgtcttcagccacgaccccctgccattgggatccagctccttccccttcgggtctggggtgcagacatgagcaaggctcaaggctgtgcaggcacataggctggtggccttgggccttggggctcagccacagcctgacacagtgctcgaccttgatagcatggggcccctggcccagagttgctgtgccgtgtccaagggccgtgcccttgcccttggagctgccgtgcctgtgtcctgatggcccaaatgtcagggttctgctcggcttcttggaccttggcgcttagtccccatcccgggtttggctgagcctggctggagagctgctatgctaaacctcctgcctcccaataccagcaggaggttctgggcctctgaaccccctttccccacacctccccctgctgctgctgccccagcgtcttgacgggagcattggcccctgagcccagagaagctggaagcctgccgaaaacaggagcaaatggcgttttataaattatttttttgaaataaaaaaaaaaaaaaaaa

SEQ ID NO: 32 - DNA, 8680 bp, Homo sapiens
acggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggatgccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaacgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcgatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacaatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 33 - DNA, 1182 bp, Homo sapiens
atggagaccaccatggggttcatggatgacaatgccaccaacacttccaccagcttcctttctgtgctcaaccctcatggagcccatgccacttccttcccattcaacttcagctacagcgactatgatatgcctttggatgaagatgaggatgtgaccaattccaggacgttctttgctgccaagattgtcattgggatggccctggtgggcatcatgctggtctgcggcattggaaacttcatctttatcgctgccctggtccgctacaagaaactgcgcaacctcaccaacctgctcatcgccaacctggccatctctgacttcctggtggccattgtctgctgcccctttgagatggactactatgtggtgcgccagctctcctgggagcacggccacgtcctgtgcacctctgtcaactacctgcgcactgtctctctctatgtctccaccaatgccctgctggccatcgccattgacaggtatctggctattgtccatccgctgagaccacggatgaagtgccaaacagccactggcctgattgccttggtgtggacggtgtccatcctgatcgccatcccttccgcctacttcaccaccgagacggtcctcgtcattgtcaagagccaggaaaagatcttctgcggccagatctggcctgtggaccagcagctctactacaagtcctacttcctctttatctttggcatagaattcgtgggccccgtggtcaccatgaccctgtgctatgccaggatctcccgggagctctggttcaaggcggtccctggattccagacagagcagatccgcaagaggctgcgctgccgcaggaagacggtcctggtgctcatgtgcatcctcaccgcctacgtgctatgctgggcgcccttctacggcttcaccatcgtgcgcgacttcttccccaccgtgttcgtgaaggagaagcactacctcactgccttctacatcgtcgagtgcatcgccatgagcaacagcatgatcaacactctgtgcttcgtgaccgtcaagaacgacaccgtcaagtacttcaaaaagatcatgttgctccactggaaggcttcttacaatggcggtaagtccagtgcagacctggacctcaagacaattgggatgcctgccaccgaagaggtggactgcatcagactaaaataa

SEQ ID NO: 34 - DNA, 4624 bp, Homo sapiens
ggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcatctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaaggcccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagatgaaataaagacccagggggagaatgggtgttgtatggggaggcaagtgtggggggtccttctccacacccactttgtccatttgcaaatatattttggaaaacagcta

SEQ ID NO: 35 - DNA, 4989 bp, Homo sapiens
ttttttttttttttgagaaagggaatttcatcccaaataaaaggaatgaagtctggctccggaggagggtccccgacctcgctgtgggggctcctgtttctctccgccgcgctctcgctctggccgacgagtggagaaatctgcgggccaggcatcgacatccgcaacgactatcagcagctgaagcgcctggagaactgcacggtgatcgagggctacctccacatcctgctcatctccaaggccgaggactaccgcagctaccgcttccccaagctcacggtcattaccgagtacttgctgctgttccgagtggctggcctcgagagcctcggagacctcttccccaacctcacggtcatccgcggctggaaactcttctacaactacgccctggtcatcttcgagatgaccaatctcaaggatattgggctttacaacctgaggaacattactcggggggccatcaggattgagaaaaatgctgacctctgttacctctccactgtggactggtccctgatcctggatgcggtgtccaataactacattgtggggaataagcccccaaaggaatgtggggacctgtgtccagggaccatggaggagaagccgatgtgtgagaagaccaccatcaacaatgagtacaactaccgctgctggaccacaaaccgctgccagaaaatgtgcccaagcacgtgtgggaagcgggcgtgcaccgagaacaatgagtgctgccaccccgagtgcctgggcagctgcagcgcgcctgacaacgacacggcctgtgtagcttgccgccactactactatgccggtgtctgtgtgcctgcctgcccgcccaacacctacaggtttgagggctggcgctgtgtggaccgtgacttctgcgccaacatcctcagcgccgagagcagcgactccgaggggtttgtgatccacgacggcgagtgcatgcaggagtgcccctcgggcttcatccgcaacggcagccagagcatgtactgcatcccttgtgaaggtccttgcccgaaggtctgtgaggaagaaaagaaaacaaagaccattgattctgttacttctgctcagatgctccaaggatgcaccatcttcaagggcaatttgctcattaacatccgacgggggaataacattgcttcagagctggagaacttcatggggctcatcgaggtggtgacgggctacgtgaagatccgccattctcatgccttggtctccttgtccttcctaaaaaaccttcgcctcatcctaggagaggagcagctagaagggaattactccttctacgtcctcgacaaccagaacttgcagcaactgtgggactgggaccaccgcaacctgaccatcaaagcagggaaaatgtactttgctttcaatcccaaattatgtgtttccgaaatttaccgcatggaggaagtgacggggactaaagggcgccaaagcaaaggggacataaacaccaggaacaacggggagagagcctcctgtgaaagtgacgtcctgcatttcacctccaccaccacgtcgaagaatcgcatcatcataacctggcaccggtaccggccccctgactacagggatctcatcagcttcaccgtttactacaaggaagcaccctttaagaatgtcacagagtatgatgggcaggatgcctgcggctccaacagctggaacatggtggacgtggacctcccgcccaacaaggacgtggagcccggcatcttactacatgggctgaagccctggactcagtacgccgtttacgtcaaggctgtgaccctcaccatggtggagaacgaccatatccgtggggccaagagtgagatcttgtacattcgcaccaatgcttcagttccttccattcccttggacgttctttcagcatcgaactcctcttctcagttaatcgtgaagtggaaccctccctctctgcccaacggcaacctgagttactacattgtgcgctggcagcggcagcctcaggacggctacctttaccggcacaattactgctccaaagacaaaatccccatcaggaagtatgccgacggcaccatcgacattgaggaggtcacagagaaccccaagactgaggtgtgtggtggggagaaagggccttgctgcgcctgccccaaaactgaagccgagaagcaggccgagaaggaggaggctgaataccgcaaagtctttgagaatttcctgcacaactccatcttcgtgcccagacctgaaaggaagcggagagatgtcatgcaagtggccaacaccaccatgtccagccgaagcaggaacaccacggccgcagacacctacaacatcaccgacccggaagagctggagacagagtaccctttctttgagagcagagtggataacaaggagagaactgtcatttctaaccttcggcctttcacattgtaccgcatcgatatccacagctgcaaccacgaggctgagaagctgggctgcagcgcctccaacttcgtctttgcaaggactatgcccgcagaaggagcagatgacattcctgggccagtgacctgggagccaaggcctgaaaactccatctttttaaagtggccggaacctgagaatcccaatggattgattctaatgtatgaaataaaatacggatcacaagttgaggatcagcgagaatgtgtgtccagacaggaatacaggaagtatggaggggccaagctaaaccggctaaacccggggaactacacagcccggattcaggccacatctctctctgggaatgggtcgtggacagatcctgtgttcttctatgtccaggccaaaacaggatatgaaaacttcatccatctgatcatcgctctgcccgtcgctgtcctgttgatcgtgggagggttggtgattatgctgtacgtcttccatagaaagagaaataacagcaggctggggaatggagtgctgtatgcctctgtgaacccggagtacttcagcgctgctgatgtgtacgttcctgatgagtgggaggtggctcgggagaagatcaccatgagccgggaacttgggcaggggtcgtttgggatggtctatgaaggagttgccaagggtgtggtgaaagatgaacctgaaaccagagtggccattaaaacagtgaacgaggccgcaagcatgcgtgagaggattgagtttctcaacgaagcttctgtgatgaaggagttcaattgtcaccatgtggtgcgattgctgggtgtggtgtcccaaggccagccaacactggtcatcatggaactgatgacacggggcgatctcaaaagttatctccggtctctgaggccagaaatggagaataatccagtcctagcacctccaagcctgagcaagatgattcagatggccggagagattgcagacggcatggcatacctcaacgccaataagttcgtccacagagaccttgctgcccggaattgcatggtagccgaagatttcacagtcaaaatcggagattttggtatgacgcgagatatctatgagacagactattaccggaaaggaggcaaagggctgctgcccgtgcgctggatgtctcctgagtccctcaaggatggagtcttcaccacttactcggacgtctggtccttcggggtcgtcctctgggagatcgccacactggccgagcagccctaccagggcttgtccaacgagcaagtccttcgcttcgtcatggagggcggccttctggacaagccagacaactgtcctgacatgctgtttgaactgatgcgcatgtgctggcagtataaccccaagatgaggccttccttcctggagatcatcagcagcatcaaagaggagatggagcctggcttccgggaggtctccttctactacagcgaggagaacaagctgcccgagccggaggagctggacctggagccagagaacatggagagcgtccccctggacccctcggcctcctcgtcctccctgccactgcccgacagacactcaggacacaaggccgagaacggccccggccctggggtgctggtcctccgcgccagcttcgacgagagacagccttacgcccacatgaacgggggccgcaagaacgagcgggccttgccgctgccccagtcttcgacctgctgatccttggatcctgaatctgtgcaaacagtaacgtgtgcgcacgcgcagcggggtggggggggagagagagttttaacaatccattcacaagcctcctgtacctcagtggatcttcagttctgcccttgctgcccgcgggagacagcttctctgcagtaaaacacatttgggatgttccttttttcaatatgcaagcagctttttattccctgcccaaacccttaactgacatgggcctttaagaaccttaatgacaacacttaatagcaacagagcacttgagaaccagtctcctcactctgtccctgtccttccctgttctccctttctctctcctctctgcttcataacggaaaaataattgccacaagtccagctgggaagccctttttatcagtttgaggaagtggctgtccctgtggccccatccaaccactgtacacacccgcctgacaccgtgggtcattacaaaaaaacacgtggagatggaaatttttacctttatctttcacctttctagggacatgaaatttacaaagggccatcgttcatccaaggctgttaccattttaacgctgcctaattttgccaaaatcctgaactttctccctcatcggcccggcgctgattcctcgtgtccggaggcatgggtgagcatggcagctggttgctccatttgagagacacgctggcgacacactccgtccatccgactgcccctgctgtgctgctcaaggccacaggcacacaggtctcattgcttctgactagattattatttgggggaactggacacaataggtctttctctcagtgaaggtggggagaagctgaaccggc

SEQ ID NO: 36 - DNA, 5896 bp, Homo sapiens
ctgcggccggcccgcgagctaggctgggtttttttttttctcccctccctcccccctttttccatgcagctgatctaaaagggaataaaaggctgcgcataatcataataataaaagaaggggagcgcgagagaaggaaagaaagccgggaggtggaagaggagggggagcgtctcaaagaagcgatcagaataataaaaggaggccgggctctttgccttctggaacgggccgctcttgaaagggcttttgaaaagtggtgttgttttccagtcgtgcatgctccaatcggcggagtatattagagccgggacgcggcggccgcaggggcagcggcgacggcagcaccggcggcagcaccagcgcgaacagcagcggcggcgtcccgagtgcccgcggcgcgcggcgcagcgatgcgttccccacggacgcgcggccggtccgggcgccccctaagcctcctgctcgccctgctctgtgccctgcgagccaaggtgtgtggggcctcgggtcagttcgagttggagatcctgtccatgcagaacgtgaacggggagctgcagaacgggaactgctgcggcggcgcccggaacccgggagaccgcaagtgcacccgcgacgagtgtgacacatacttcaaagtgtgcctcaaggagtatcagtcccgcgtcacggccggggggccctgcagcttcggctcagggtccacgcctgtcatcgggggcaacaccttcaacctcaaggccagccgcggcaacgaccgcaaccgcatcgtgctgcctttcagtttcgcctggccgaggtcctatacgttgcttgtggaggcgtgggattccagtaatgacaccgttcaacctgacagtattattgaaaaggcttctcactcgggcatgatcaaccccagccggcagtggcagacgctgaagcagaacacgggcgttgcccactttgagtatcagatccgcgtgacctgtgatgactactactatggctttggctgcaataagttctgccgccccagagatgacttctttggacactatgcctgtgaccagaatggcaacaaaacttgcatggaaggctggatgggccccgaatgtaacagagctatttgccgacaaggctgcagtcctaagcatgggtcttgcaaactcccaggtgactgcaggtgccagtatggctggcaaggcctgtactgtgataagtgcatcccacacccgggatgcgtccacggcatctgtaatgagccctggcagtgcctctgtgagaccaactggggcggccagctctgtgacaaagatctcaattactgtgggactcatcagccgtgtctcaacgggggaacttgtagcaacacaggccctgacaaatatcagtgttcctgccctgaggggtattcaggacccaactgtgaaattgctgagcacgcctgcctctctgatccctgtcacaacagaggcagctgtaaggagacctccctgggctttgagtgtgagtgttccccaggctggaccggccccacatgctctacaaacattgatgactgttctcctaataactgttcccacgggggcacctgccaggacctggttaacggatttaagtgtgtgtgccccccacagtggactgggaaaacgtgccagttagatgcaaatgaatgtgaggccaaaccttgtgtaaacgccaaatcctgtaagaatctcattgccagctactactgcgactgtcttcccggctggatgggtcagaattgtgacataaatattaatgactgccttggccagtgtcagaatgacgcctcctgtcgggatttggttaatggttatcgctgtatctgtccacctggctatgcaggcgatcactgtgagagagacatcgatgaatgtgccagcaacccctgtttgaatgggggtcactgtcagaatgaaatcaacagattccagtgtctgtgtcccactggtttctctggaaacctctgtcagctggacatcgattattgtgagcctaatccctgccagaacggtgcccagtgctacaaccgtgccagtgactatttctgcaagtgccccgaggactatgagggcaagaactgctcacacctgaaagaccactgccgcacgaccccctgtgaagtgattgacagctgcacagtggccatggcttccaacgacacacctgaaggggtgcggtatatttcctccaacgtctgtggtcctcacgggaagtgcaagagtcagtcgggaggcaaattcacctgtgactgtaacaaaggcttcacgggaacatactgccatgaaaatattaatgactgtgagagcaacccttgtagaaacggtggcacttgcatcgatggtgtcaactcctacaagtgcatctgtagtgacggctgggagggggcctactgtgaaaccaatattaatgactgcagccagaacccctgccacaatgggggcacgtgtcgcgacctggtcaatgacttctactgtgactgtaaaaatgggtggaaaggaaagacctgccactcacgtgacagtcagtgtgatgaggccacgtgcaacaacggtggcacctgctatgatgagggggatgcttttaagtgcatgtgtcctggcggctgggaaggaacaacctgtaacatagcccgaaacagtagctgcctgcccaacccctgccataatgggggcacatgtgtggtcaacggcgagtcctttacgtgcgtctgcaaggaaggctgggaggggcccatctgtgctcagaataccaatgactgcagccctcatccctgttacaacagcggcacctgtgtggatggagacaactggtaccggtgcgaatgtgccccgggttttgctgggcccgactgcagaataaacatcaatgaatgccagtcttcaccttgtgcctttggagcgacctgtgtggatgagatcaatggctaccggtgtgtctgccctccagggcacagtggtgccaagtgccaggaagtttcagggagaccttgcatcaccatggggagtgtgataccagatggggccaaatgggatgatgactgtaatacctgccagtgcctgaatggacggatcgcctgctcaaaggtctggtgtggccctcgaccttgcctgctccacaaagggcacagcgagtgccccagcgggcagagctgcatccccatcctggacgaccagtgcttcgtccacccctgcactggtgtgggcgagtgtcggtcttccagtctccagccggtgaagacaaagtgcacctctgactcctattaccaggataactgtgcgaacatcacatttacctttaacaaggagatgatgtcaccaggtcttactacggagcacatttgcagtgaattgaggaatttgaatattttgaagaatgtttccgctgaatattcaatctacatcgcttgcgagccttccccttcagcgaacaatgaaatacatgtggccatttctgctgaagatatacgggatgatgggaacccgatcaaggaaatcactgacaaaataatcgatcttgttagtaaacgtgatggaaacagctcgctgattgctgccgttgcagaagtaagagttcagaggcggcctctgaagaacagaacagatttccttgttcccttgctgagctctgtcttaactgtggcttggatctgttgcttggtgacggccttctactggtgcctgcggaagcggcggaagccgggcagccacacacactcagcctctgaggacaacaccaccaacaacgtgcgggagcagctgaaccagatcaaaaaccccattgagaaacatggggccaacacggtccccatcaaggattacgagaacaagaactccaaaatgtctaaaataaggacacacaattctgaagtagaagaggacgacatggacaaacaccagcagaaagcccggtttgccaagcagccggcgtatacgctggtagacagagaagagaagccccccaacggcacgccgacaaaacacccaaactggacaaacaaacaggacaacagagacttggaaagtgcccagagcttaaaccgaatggagtacatcgtatagcagaccgcgggcactgccgccgctaggtagagtctgagggcttgtagttctttaaactgtcgtgtcatactcgagtctgaggccgttgctgacttagaatccctgtgttaatttaagttttgacaagctggcttacactggcaatggtagtttctgtggttggctgggaaatcgagtgccgcatctcacagctatgcaaaaagctagtcaacagtaccctggttgtgtgtccccttgcagccgacacggtctcggatcaggctcccaggagcctgcccagccccctggtctttgagctcccacttctgccagatgtcctaatggtgatgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttatttttttaattgtatttttgttgttgggggaggggagactttgatgtcagcagttgctggtaaaatgaagaatttaaagaaaaaaatgtcaaaagtagaactttgtatagttatgtaaataattcttttttattaatcactgtgtatatttgatttattaacttaataatcaagagccttaaaacatcattcctttttatttatatgtatgtgtttagaattgaaggtttttgatagcattgtaagcgtatggctttatttttttgaactcttctcattacttgttgcctataagccaaaattaaggtgtttgaaaatagtttattttaaaacaataggatgggcttctgtgcccagaatactgatggaattttttttgtacgacgtcagatgtttaaaacaccttctatagcatcacttaaaacacgttttaaggactgactgaggcagtttgaggattagtttagaacaggtttttttgtttgtttgttttttgtttttctgctttagacttgaaaagagacaggcaggtgatctgctgcagagcagtaagggaacaagttgagctatgacttaacatagccaaaatgtgagtggttgaatatgattaaaaatatcaaattaattgtgtgaacttggaagcacaccaatctgactttgtaaattctgatttcttttcaccattcgtacataatactgaaccacttgtagatttgattttttttttaatctactgcatttagggagtattctaataagctagttgaatacttgaaccataaaatgtccagtaagatcactgtttagatttgccatagagtacactgcctgccttaagtgaggaaatcaaagtgctattacgaagttcaagatcaaaaaggcttataaaacagagtaatcttgttggttcaccattgagaccgtgaagatactttgtattgtcctattagtgttatatgaacatacaaatgcatctttgatgtgttgttcttggcaataaattttgaaaagtaatatttattaaatttttttgtatgaaaacatggaacagtgtggctcttctgagcttacgtagttctaccggctttgccgtgtgcttctgccaccctgctgagtctgttctggtaatcggggtataataggctctgcctgacagagggatggaggaagaactgaaaggcttttcaaccacaaaactcatctggagttctcaaagacctggggctgctgtgaagctggaactgcgggagccccatctaggggagccttgattcccttgttattcaacagcaagtgtgaatactgcttgaataaacaccactggattaatggaaaaaaaaaaaaaaaa

SEQ ID NO: 37 - DNA, 5077 bp, Homo sapiens
ctcatgcatatgcaggtgcgcgggtgacgaatgggcgagcgagctgtcagtctcgttccgaacttgttggctgcggtgccgggagcgcgggcgcgcagagccgaggccgggacccgctgccttcaccgccgccgccgtcgccgccgggtgggagccgggccgggcagccggagcgcggccgccagcgagccggagctgccgccgcccctgcacgcccgccgcccaggcccgcgcgccgcggcgctgcgctcgaccccgcccgcgccgccgccgccgccgcctctgccgctgccgctgcctctgcgggcgctcggagggcgggcgggcgctgggaggccggcgcggcggctgggagccgggcgcgggcggcggcggcggggccgggcgggcgggtcgcgggggcaatgcgggcgcagggccgggggcgccttccccggcggctgctgctgctgctggcgctctgggtgcaggcggcgcggcccatgggctatttcgagctgcagctgagcgcgctgcggaacgtgaacggggagctgctgagcggcgcctgctgtgacggcgacggccggacaacgcgcgcggggggctgcggccacgacgagtgcgacacgtacgtgcgcgtgtgccttaaggagtaccaggccaaggtgacgcccacggggccctgcagctacggccacggcgccacgcccgtgctgggcggcaactccttctacctgccgccggcgggcgctgcgggggaccgagcgcgggcgcgggcccgggccggcggcgaccaggacccgggcctcgtcgtcatccccttccagttcgcctggccgcgctcctttaccctcatcgtggaggcctgggactgggacaacgataccaccccgaatgaggagctgctgatcgagcgagtgtcgcatgccggcatgatcaacccggaggaccgctggaagagcctgcacttcagcggccacgtggcgcacctggagctgcagatccgcgtgcgctgcgacgagaactactacagcgccacttgcaacaagttctgccggccccgcaacgactttttcggccactacacctgcgaccagtacggcaacaaggcctgcatggacggctggatgggcaaggagtgcaaggaagctgtgtgtaaacaagggtgtaatttgctccacgggggatgcaccgtgcctggggagtgcaggtgcagctacggctggcaagggaggttctgcgatgagtgtgtcccctaccccggctgcgtgcatggcagttgtgtggagccctggcagtgcaactgtgagaccaactggggcggcctgctctgtgacaaagacctgaactactgtggcagccaccacccctgcaccaacggaggcacgtgcatcaacgccgagcctgaccagtaccgctgcacctgccctgacggctactcgggcaggaactgtgagaaggctgagcacgcctgcacctccaacccgtgtgccaacgggggctcttgccatgaggtgccgtccggcttcgaatgccactgcccatcgggctggagcgggcccacctgtgcccttgacatcgatgagtgtgcttcgaacccgtgtgcggccggtggcacctgtgtggaccaggtggacggctttgagtgcatctgccccgagcagtgggtgggggccacctgccagctggacgccaatgagtgtgaagggaagccatgccttaacgctttttcttgcaaaaacctgattggcggctattactgtgattgcatcccgggctggaagggcatcaactgccatatcaacgtcaacgactgtcgcgggcagtgtcagcatgggggcacctgcaaggacctggtgaacgggtaccagtgtgtgtgcccacggggcttcggaggccggcattgcgagctggaacgagacgagtgtgccagcagcccctgccacagcggcggcctctgcgaggacctggccgacggcttccactgccactgcccccagggcttctccgggcctctctgtgaggtggatgtcgacctttgtgagccaagcccctgccggaacggcgctcgctgctataacctggagggtgactattactgcgcctgccctgatgactttggtggcaagaactgctccgtgccccgcgagccgtgccctggcggggcctgcagagtgatcgatggctgcgggtcagacgcggggcctgggatgcctggcacagcagcctccggcgtgtgtggcccccatggacgctgcgtcagccagccagggggcaacttttcctgcatctgtgacagtggctttactggcacctactgccatgagaacattgacgactgcctgggccagccctgccgcaatgggggcacatgcatcgatgaggtggacgccttccgctgcttctgccccagcggctgggagggcgagctctgcgacaccaatcccaacgactgccttcccgatccctgccacagccgcggccgctgctacgacctggtcaatgacttctactgtgcgtgcgacgacggctggaagggcaagacctgccactcacgcgagttccagtgcgatgcctacacctgcagcaacggtggcacctgctacgacagcggcgacaccttccgctgcgcctgcccccccggctggaagggcagcacctgcgccgtcgccaagaacagcagctgcctgcccaacccctgtgtgaatggtggcacctgcgtgggcagcggggcctccttctcctgcatctgccgggacggctgggagggtcgtacttgcactcacaataccaacgactgcaaccctctgccttgctacaatggtggcatctgtgttgacggcgtcaactggttccgctgcgagtgtgcacctggcttcgcggggcctgactgccgcatcaacatcgacgagtgccagtcctcgccctgtgcctacggggccacgtgtgtggatgagatcaacgggtatcgctgtagctgcccacccggccgagccggcccccggtgccaggaagtgatcgggttcgggagatcctgctggtcccggggcactccgttcccacacggaagctcctgggtggaagactgcaacagctgccgctgcctggatggccgccgtgactgcagcaaggtgtggtgcggatggaagccttgtctgctggccggccagcccgaggccctgagcgcccagtgcccactggggcaaaggtgcctggagaaggccccaggccagtgtctgcgaccaccctgtgaggcctggggggagtgcggcgcagaagagccaccgagcaccccctgcctgccacgctccggccacctggacaataactgtgcccgcctcaccttgcatttcaaccgtgaccacgtgccccagggcaccacggtgggcgccatttgctccgggatccgctccctgccagccacaagggctgtggcacgggaccgcctgctggtgttgctttgcgaccgggcgtcctcgggggccagtgccgtggaggtggccgtgtccttcagccctgccagggacctgcctgacagcagcctgatccagggcgcggcccacgccatcgtggccgccatcacccagcgggggaacagctcactgctcctggctgtcaccgaggtcaaggtggagacggttgttacgggcggctcttccacaggtctgctggtgcctgtgctgtgtggtgccttcagcgtgctgtggctggcgtgcgtggtcctgtgcgtgtggtggacacgcaagcgcaggaaagagcgggagaggagccggctgccgcgggaggagagcgccaacaaccagtgggccccgctcaaccccatccgcaaccccatcgagcggccggggggccacaaggacgtgctctaccagtgcaagaacttcacgccgccgccgcgcagggcggacgaggcgctgcccgggccggccggccacgcggccgtcagggaggatgaggaggacgaggatctgggccgcggtgaggaggactccctggaggcggagaagttcctctcacacaaattcaccaaagatcctggccgctcgccggggaggccggcccactgggcctcaggccccaaagtggacaaccgcgcggtcaggagcatcaatgaggcccgctacgccggcaaggagtaggggcggctgccagctgggccgggacccagggccctcggtgggagccatgccgtctgccggacccggaggccgaggccatgtgcatagtttctttattttgtgtaaaaaaaccaccaaaaacaaaaaccaaatgtttattttctacgtttctttaaccttgtataaattattcagtaactgtcaggctgaaaacaatggagtattctcggatagttgctatttttgtaaagtttccgtgcgtggcactcgctgtatgaaaggagagagcaaagggtgtctgcgtcgtcaccaaatcgtagcgtttgttaccagaggttgtgcactgtttacagaatcttccttttattcctcactcgggtttctctgtggctccaggccaaagtgccggtgagacccatggctgtgttggtgtggcccatggctgttggtgggacccgtggctgatggtgtggcctgtggctgtcggtgggactcgtggctgtcaatgggacctgtggctgtcggtgggacctacggtggtcggtgggaccctggttattgatgtggccctggctgccggcacggcccgtggctgttgacgcacctgtggttgttagtggggcctgaggtcatcggcgtggcccaaggccggcaggtcaacctcgcgcttgctggccagtccaccctgcctgccgtctgtgcttcctcctgcccagaacgcccgctccagcgatctctccactgtgctttcagaagtgcccttcctgctgcgcagttctcccatcctgggacggcggcagtattgaagctcgtgacaagtgccttcacacagacccctcgcaactgtccacgcgtgccgtggcaccaggcgctgcccacctgccggccccggccgcccctcctcgtgaaagtgcatttttgtaaatgtgtacatattaaaggaagcactctgtatatttgattgaataatgccacca

SEQ ID NO: 38 - DNA, 5097 bp, Homo sapiens
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgccccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtctgttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaatta

SEQ ID NO: 39 - DNA, 5312 bp, Homo sapiens
ggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggcctgctgaaaatgactgaatataaacttgtggtagttggagctggtggcgtaggcaagagtgccttgacgatacagctaattcagaatcattttgtggacgaatatgatccaacaatagaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattatagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctctaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgatgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataaaaacaatccttttgataaatttaaaatgttacttattttaaaataaatgaagtgagatggcatggtgaggtgaaagtatcactggactaggaagaaggtgacttaggttctagataggtgtcttttaggactctgattttgaggacatcacttactatccatttcttcatgttaaaagaagtcatctcaaactcttagttttttttttttacaactatgtaatttatattccatttacataaggatacacttatttgtcaagctcagcacaatctgtaaatttttaacctatgttacaccatcttcagtgccagtcttgggcaaaattgtgcaagaggtgaagtttatatttgaatatccattctcgttttaggactcttcttccatattagtgtcatcttgcctccctaccttccacatgccccatgacttgatgcagttttaatacttgtaattcccctaaccataagatttactgctgctgtggatatctccatgaagttttcccactgagtcacatcagaaatgccctacatcttatttcctcagggctcaagagaatctgacagataccataaagggatttgacctaatcactaattttcaggtggtggctgatgctttgaacatctctttgctgcccaatccattagcgacagtaggatttttcaaacctggtatgaatagacagaaccctatccagtggaaggagaatttaataaagatagtgctgaaagaattccttaggtaatctataactaggactactcctggtaacagtaatacattccattgttttagtaaccagaaatcttcatgcaatgaaaaatactttaattcatgaagcttactttttttttttggtgtcagagtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccgcacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaagtttttttaaaaaaagctaaattacatagacttaggcattaacatgtttgtggaagaatatagcagacgtatattgtatcatttgagtgaatgttcccaagtaggcattctaggctctatttaactgagtcacactgcataggaatttagaacctaacttttataggttatcaaaactgttgtcaccattgcacaattttgtcctaatatatacatagaaactttgtggggcatgttaagttacagtttgcacaagttcatctcatttgtattccattgattttttttttcttctaaacattttttcttcaaacagtatataactttttttaggggatttttttttagacagcaaaaactatctgaagatttccatttgtcaaaaagtaatgatttcttgataattgtgtagtaatgttttttagaacccagcagttaccttaaagctgaatttatatttagtaacttctgtgttaatactggatagcatgaattctgcattgagaaactgaatagctgtcataaaatgaaactttctttctaaagaaagatactcacatgagttcttgaagaatagtcataactagattaagatctgtgttttagtttaatagtttgaagtgcctgtttgggataatgataggtaatttagatgaatttaggggaaaaaaaagttatctgcagatatgttgagggcccatctctccccccacacccccacagagctaactgggttacagtgttttatccgaaagtttccaattccactgtcttgtgttttcatgttgaaaatacttttgcatttttcctttgagtgccaatttcttactagtactatttcttaatgtaacatgtttacctggaatgtattttaactatttttgtatagtgtaaactgaaacatgcacattttgtacattgtgctttcttttgtgggacatatgcagtgtgatccagttgttttccatcatttggttgcgctgacctaggaatgttggtcatatcaaacattaaaaatgaccactcttttaattgaaattaacttttaaatgtttataggagtatgtgctgtgaagtgatctaaaatttgtaatatttttgtcatgaactgtactactcctaattattgtaatgtaataaaaatagttacagtgacaaaaaaaaaaaaaaa

SEQ ID NO: 40 - DNA, 2222 bp, Homo sapiens
attcggcacgagggaggaagcgagaggtgctgccctccccccggagttggaagcgcgttacccgggtccaaaatgcccaagaagaagccgacgcccatccagctgaacccggcccccgacggctctgcagttaacgggaccagctctgcggagaccaacttggaggccttgcagaagaagctggaggagctagagcttgatgagcagcagcgaaagcgccttgaggcctttcttacccagaagcagaaggtgggagaactgaaggatgacgactttgagaagatcagtgagctgggggctggcaatggcggtgtggtgttcaaggtctcccacaagccttctggcctggtcatggccagaaagctaattcatctggagatcaaacccgcaatccggaaccagatcataagggagctgcaggttctgcatgagtgcaactctccgtacatcgtgggcttctatggtgcgttctacagcgatggcgagatcagtatctgcatggagcacatggatggaggttctctggatcaagtcctgaagaaagctggaagaattcctgaacaaattttaggaaaagttagcattgctgtaataaaaggcctgacatatctgagggagaagcacaagatcatgcacagagatgtcaagccctccaacatcctagtcaactcccgtggggagatcaagctctgtgactttggggtcagcgggcagctcatcgactccatggccaactccttcgtgggcacaaggtcctacatgtcgccagaaagactccaggggactcattactctgtgcagtcagacatctggagcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacctcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatctgatgctgaggaagtggattttgcaggttggctctgctccaccatcggccttaaccagcccagcacaccaacccatgctgctggcgtctaagtgtttgggaagcaacaaagagcgagtcccctgcccggtggtttgccatgtcgcttttgggcctccttcccatgcctgtctctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtgccaggctgaattacagtgaaatttttggtgaatgtgggtagtcattcttacaattgcactgctgttcctgctccatgactggctgtctgcctgtattttcggactttgacatttgacatttggtggactttatcttgctgggcatactttctctctaggagggagccttgtgagatccttcacaggcagtgcatgtgaagcatgctttgctgctatgaaaatgagcatcagagagtgtacatcatgttattttattattattatttgcttttcatgtagaactcagcagttgacatccaaatctagccagagcccttcactgccatgatagctggggcttcaccagtctgtctactgtggtgatctgtagacttctggttgtatttctatatttattttcagtatactgtgtgggatacttagtggtatgtctctttaagttttgattaatgtttcttaaatggaattatttgaatgtcacaaattgatcaagatattaaaatgtcggatttatctttccccatatccaagtaccaatgctgttgtaaacaacgtgtatagtgcctaaaattgtatgaaaatccttttaaccattttaacctagatgtttaacaaatctaatctcttattctaataaatatactatgaaataaaaaaaaaaggagaaagctaaaaaaaaaaaaaaaaaaaaaaaaaaaaaaaaaaaaaaa

SEQ ID NO: 41 - DNA, 2501 bp, Homo sapiens
cgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaaaaaaaaaaaaaaaaaaaaaaaaaaaaaaaaaaaaaaaaaaaaaaaaaaaaaaaa

SEQ ID NO: 42 - DNA, 11433 bp, Homo sapiens
aggctgcttcgttgcacacccgagaaagtttcagccaaacttcgggcggcggctgaggcggcggccgaggagcggcggactcggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagatgcccgccctgcgccccgctctgctgtgggcgctgctggcgctctggctgtgctgcgcggcccccgcgcatgcattgcagtgtcgagatggctatgaaccctgtgtaaatgaaggaatgtgtgttacctaccacaatggcacaggatactgcaaatgtccagaaggcttcttgggggaatattgtcaacatcgagacccctgtgagaagaaccgctgccagaatggtgggacttgtgtggcccaggccatgctggggaaagccacgtgccgatgtgcctcagggtttacaggagaggactgccagtactcaacatctcatccatgctttgtgtctcgaccctgcctgaatggcggcacatgccatatgctcagccgggatacctatgagtgcacctgtcaagtcgggtttacaggtaaggagtgccaatggacggatgcctgcctgtctcatccctgtgcaaatggaagtacctgtaccactgtggccaaccagttctcctgcaaatgcctcacaggcttcacagggcagaaatgtgagactgatgtcaatgagtgtgacattccaggacactgccagcatggtggcacctgcctcaacctgcctggttcctaccagtgccagtgccctcagggcttcacaggccagtactgtgacagcctgtatgtgccctgtgcaccctcaccttgtgtcaatggaggcacctgtcggcagactggtgacttcacttttgagtgcaactgccttccaggttttgaagggagcacctgtgagaggaatattgatgactgccctaaccacaggtgtcagaatggaggggtttgtgtggatggggtcaacacttacaactgccgctgtcccccacaatggacaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatggccaatagcaatccttgtgagcatgcaggaaaatgtgtgaacacggatggcgccttccactgtgagtgtctgaagggttatgcaggacctcgttgtgagatggacatcaatgagtgccattcagacccctgccagaatgatgctacctgtctggataagattggaggcttcacatgtctgtgcatgccaggtttcaaaggtgtgcattgtgaattagaaataaatgaatgtcagagcaacccttgtgtgaacaatgggcagtgtgtggataaagtcaatcgtttccagtgcctgtgtcctcctggtttcactgggccagtttgccagattgatattgatgactgttccagtactccgtgtctgaatggggcaaagtgtatcgatcacccgaatggctatgaatgccagtgtgccacaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggggttaattgtgaaattaattttgatgactgtgcaagtaacccttgtatccatggaatctgtatggatggcattaatcgctacagttgtgtctgctcaccaggattcacagggcagagatgtaacattgacattgatgagtgtgcctccaatccctgtcgcaagggtgcaacatgtatcaacggtgtgaatggtttccgctgtatatgccccgagggaccccatcaccccagctgctactcacaggtgaacgaatgcctgagcaatccctgcatccatggaaactgtactggaggtctcagtggatataagtgtctctgtgatgcaggctgggttggcatcaactgtgaagtggacaaaaatgaatgcctttcgaatccatgccagaatggaggaacttgtgacaatctggtgaatggatacaggtgtacttgcaagaagggctttaaaggctataactgccaggtgaatattgatgaatgtgcctcaaatccatgcctgaaccaaggaacctgctttgatgacataagtggctacacttgccactgtgtgctgccatacacaggcaagaattgtcagacagtattggctccctgttccccaaacccttgtgagaatgctgctgtttgcaaagagtcaccaaattttgagagttatacttgcttgtgtgctcctggctggcaaggtcagcggtgtaccattgacattgacgagtgtatctccaagccctgcatgaaccatggtctctgccataacacccagggcagctacatgtgtgaatgtccaccaggcttcagtggtatggactgtgaggaggacattgatgactgccttgccaatccttgccagaatggaggttcctgtatggatggagtgaatactttctcctgcctctgccttccgggtttcactggggataagtgccagacagacatgaatgagtgtctgagtgaaccctgtaagaatggagggacctgctctgactacgtcaacagttacacttgcaagtgccaggcaggatttgatggagtccattgtgagaacaacatcaatgagtgcactgagagctcctgtttcaatggtggcacatgtgttgatgggattaactccttctcttgcttgtgccctgtgggtttcactggatccttctgcctccatgagatcaatgaatgcagctctcatccatgcctgaatgagggaacgtgtgttgatggcctgggtacctaccgctgcagctgccccctgggctacactgggaaaaactgtcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggccggcactgtgaaaccttcgtcgatgtgtgtccccagatgccctgcctgaatggagggacttgtgctgtggccagtaacatgcctgatggtttcatttgccgttgtcccccgggattttccggggcaaggtgccagagcagctgtggacaagtgaaatgtaggaagggggagcagtgtgtgcacaccgcctctggaccccgctgcttctgccccagtccccgggactgcgagtcaggctgtgccagtagcccctgccagcacgggggcagctgccaccctcagcgccagcctccttattactcctgccagtgtgccccaccattctcgggtagccgctgtgaactctacacggcaccccccagcacccctcctgccacctgtctgagccagtattgtgccgacaaagctcgggatggcgtctgtgatgaggcctgcaacagccatgcctgccagtgggatgggggtgactgttctctcaccatggagaacccctgggccaactgctcctccccacttccctgctgggattatatcaacaaccagtgtgatgagctgtgcaacacggtcgagtgcctgtttgacaactttgaatgccaggggaacagcaagacatgcaagtatgacaaatactgtgcagaccacttcaaagacaaccactgtgaccaggggtgcaacagtgaggagtgtggttgggatgggctggactgtgctgctgaccaacctgagaacctggcagaaggtaccctggttattgtggtattgatgccacctgaacaactgctccaggatgctcgcagcttcttgcgggcactgggtaccctgctccacaccaacctgcgcattaagcgggactcccagggggaactcatggtgtacccctattatggtgagaagtcagctgctatgaagaaacagaggatgacacgcagatcccttcctggtgaacaagaacaggaggtggctggctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaaaaatctctcagtgcaagtctcagaagctaacctaattggtactggaacaagtgaacactgggtcgatgatgaagggccccagccaaagaaagtaaaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccagatggctgcaccccattgatgttggcttctctccgaggaggcagctcagatttgagtgatgaagatgaagatgcagaggactcttctgctaacatcatcacagacttggtctaccagggtgccagcctccaggcccagacagaccggactggtgagatggccctgcaccttgcagcccgctactcacgggctgatgctgccaagcgtctcctggatgcaggtgcagatgccaatgcccaggacaacatgggccgctgtccactccatgctgcagtggcagctgatgcccaaggtgtcttccagattctgattcgcaaccgagtaactgatctagatgccaggatgaatgatggtactacacccctgatcctggctgcccgcctggctgtggagggaatggtggcagaactgatcaactgccaagcggatgtgaatgcagtggatgaccatggaaaatctgctcttcactgggcagctgctgtcaataatgtggaggcaactcttttgttgttgaaaaatggggccaaccgagacatgcaggacaacaaggaagagacacctctgtttcttgctgcccgggaggggagctatgaagcagccaagatcctgttagaccattttgccaatcgagacatcacagaccatatggatcgtcttccccgggatgtggctcgggatcgcatgcaccatgacattgtgcgccttctggatgaatacaatgtgaccccaagccctccaggcaccgtgttgacttctgctctctcacctgtcatctgtgggcccaacagatctttcctcagcctgaagcacaccccaatgggcaagaagtctagacggcccagtgccaagagtaccatgcctactagcctccctaaccttgccaaggaggcaaaggatgccaagggtagtaggaggaagaagtctctgagtgagaaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccagtgtagagacataactgacttttgtaaatgctgctgaggaacaaatgaaggtcatccgggagagaaatgaagaaatctctggagccagcttctagaggtaggaaagagaagatgttcttattcagataatgcaagagaagcaattcgtcagtttcactgggtatctgcaaggcttattgattattctaatctaataagacaagtttgtggaaatgcaagatgaatacaagccttgggtccatgtttactctcttctatttggagaataagatggatgcttattgaagcccagacattcttgcagcttggactgcattttaagccctgcaggcttctgccatatccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggtttgtaacattccttaagtgaaatttgtgtagaacttaatatacaggattataaaataatattttgtgtataaatttgttataagttcacattcatacatttatttataaagtcagtgagatatttgaacatgaaaaaaaaaa

SEQ ID NO: 43 - DNA, 8091 bp, Homo sapiens
acgcggcgcggaggctggcccgggacgcgcccggagcccagggaaggagggaggaggggagggtcgcggccggccgccatggggccgggggcccgtggccgccgccgccgccgtcgcccgatgtcgccgccaccgccaccgccacccgtgcgggcgctgcccctgctgctgctgctagcggggccgggggctgcagcccccccttgcctggacggaagcccgtgtgcaaatggaggtcgttgcacccagctgccctcccgggaggctgcctgcctgtgcccgcctggctgggtgggtgagcggtgtcagctggaggacccctgtcactcaggcccctgtgctggccgtggtgtctgccagagttcagtggtggctggcaccgcccgattctcatgccggtgcccccgtggcttccgaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcgccctcaccatgccgtaacgggggcacctgcaggcagagtggcgacctcacttacgactgtgcctgtcttcctgggtttgagggtcagaattgtgaagtgaacgtggacgactgtccaggacaccgatgtctcaatggggggacatgcgtggatggcgtcaacacctataactgccagtgccctcctgagtggacaggccagttctgcacggaggacgtggatgagtgtcagctgcagcccaacgcctgccacaatgggggtacctgcttcaacacgctgggtggccacagctgcgtgtgtgtcaatggctggacaggtgagagctgcagtcagaatatcgatgactgtgccacagccgtgtgcttccatggggccacctgccatgaccgcgtggcttctttctactgtgcctgccccatgggcaagactggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggcttcacaggaacctattgcgaggtggacattgacgagtgtcagagtagcccctgtgtcaacggtggggtctgcaaggaccgagtcaatggcttcagctgcacctgcccctcgggcttcagcggctccacgtgtcagctggacgtggacgaatgcgccagcacgccctgcaggaatggcgccaaatgcgtggaccagcccgatggctacgagtgccgctgtgccgagggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgtgaactgcgaagtgaacattgacgactgtgccagcaacccctgcacctttggagtctgccgtgatggcatcaaccgctacgactgtgtctgccaacctggcttcacagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggacgtcagtgtgaactcctctccccctgcaccccgaacccctgtgagcatgggggccgctgcgagtctgcccctggccagctgcctgtctgctcctgcccccagggctggcaaggcccacgatgccagcaggatgtggacgagtgtgctggccccgcaccctgtggccctcatggtatctgcaccaacctggcagggagtttcagctgcacctgccatggagggtacactggcccttcctgtgatcaggacatcaatgactgtgaccccaacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccgggctacggaggcttccactgcgaacaggacctgcccgactgcagccccagctcctgcttcaatggcgggacctgtgtggacggcgtgaactcgttcagctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgagtgtcttcctggctacaatggtgataactgtgaggacgacgtggacgagtgtgcctcccagccctgccagcacgggggttcatgcattgacctcgtggcccgctatctctgctcctgtcccccaggaacgctgggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtcctcgctgtcagactgtcctgtctccctgcgagtcccagccatgccagcatggaggccagtgccgtcctagcccgggtcctgggggtgggctgaccttcacctgtcactgtgcccagccgttctggggtccgcgttgcgagcgggtggcgcgctcctgccgggagctgcagtgcccggtgggcgtcccatgccagcagacgccccgcgggccgcgctgcgcctgccccccagggttgtcgggaccctcctgccgcagcttcccggggtcgccgccgggggccagcaacgccagctgcgcggccgccccctgtctccacgggggctcctgccgccccgcgccgctcgcgcccttcttccgctgcgcttgcgcgcagggctggaccgggccgcgctgcgaggcgcccgccgcggcacccgaggtctcggaggagccgcggtgcccgcgcgccgcctgccaggccaagcgcggggaccagcgctgcgaccgcgagtgcaacagcccaggctgcggctgggacggcggcgactgctcgctgagcgtgggcgacccctggcggcaatgcgaggcgctgcagtgctggcgcctcttcaacaacagccgctgcgaccccgcctgcagctcgcccgcctgcctctacgacaacttcgactgccacgccggtggccgcgagcgcacttgcaacccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccggaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcggctcggtagtaatgctggagattgacaaccggctctgcctgcagtcgcctgagaatgatcactgcttccccgatgcccagagcgccgctgactacctgggagcgttgtcagcggtggagcgcctggacttcccgtacccactgcgggacgtgcggggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagaacatggccaagggtgagagcctgatgggggaggtggccacagactggatggacacagagtgcccagaggccaagcggctaaaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccagatggcttcaccccgctaatgctggcttccttctgtgggggggctctggagccaatgccaactgaagaggatgaggcagatgacacatcagctagcatcatctccgacctgatctgccagggggctcagcttggggcacggactgaccgtactggcgagactgctttgcacctggctgcccgttatgcccgtgctgatgcagccaagcggctgctggatgctggggcagacaccaatgcccaggaccactcaggccgcactcccctgcacacagctgtcacagccgatgcccagggtgtcttccagattctcatccgaaaccgctctacagacttggatgcccgcatggcagatggctcaacggcactgatcctggcggcccgcctggcagtagagggcatggtggaagagctcatcgccagccatgctgatgtcaatgctgtggatgagcttgggaaatcagccttacactgggctgcggctgtgaacaacgtggaagccactttggccctgctcaaaaatggagccaataaggacatgcaggatagcaaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcaggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggtggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttctttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagattggacatgttccatagccttgctggggaagggcccactgccaactccctctgccccagccccacccttggccatctccctttgggaactagggggctgctggtgggaaatgggagccagggcagatgtatgcattcctttatgtccctgtaaatgtgggactacaagaagaggagctgcctgagtggtactttctcttcctggtaatcctctggcccagccttatggcagaatagaggtatttttaggctatttttgtaatatggcttctggtcaaaatccctgtgtagctgaattcccaagccctgcattgtacagccccccactcccctcaccacctaataaaggaatagttaacactcaaaaaaaaaaaaaaaaaaa

SEQ ID NO: 44 - DNA, 2772 bp, Homo sapiens
atggagagggggctgccgctcctctgcgccgtgctcgccctcgtcctcgccccggccggcgcttttcgcaacgatgaatgtggcgatactataaaaattgaaagccccgggtaccttacatctcctggttatcctcattcttatcacccaagtgaaaaatgcgaatggctgattcaggctccggacccataccagagaattatgatcaacttcaaccctcacttcgatttggaggacagagactgcaagtatgactacgtggaagtcttcgatggagaaaatgaaaatggacattttaggggaaagttctgtggaaagatagcccctcctcctgttgtgtcttcagggccatttctttttatcaaatttgtctctgactacgaaacacatggtgcaggattttccatacgttatgaaattttcaagagaggtcctgaatgttcccagaactacacaacacctagtggagtgataaagtcccccggattccctgaaaaatatcccaacagccttgaatgcacttatattgtctttgcgccaaagatgtcagagattatcctggaatttgaaagctttgacctggagcctgactcaaatcctccaggggggatgttctgtcgctacgaccggctagaaatctgggatggattccctgatgttggccctcacattgggcgttactgtggacagaaaacaccaggtcgaatccgatcctcatcgggcattctctccatggttttttacaccgacagcgcgatagcaaaagaaggtttctcagcaaactacagtgtcttgcagagcagtgtctcagaagatttcaaatgtatggaagctctgggcatggaatcaggagaaattcattctgaccagatcacagcttcttcccagtatagcaccaactggtctgcagagcgctcccgcctgaactaccctgagaatgggtggactcccggagaggattcctaccgagagtggatacaggtagacttgggccttctgcgctttgtcacggctgtcgggacacagggcgccatttcaaaagaaaccaagaagaaatattatgtcaagacttacaagatcgacgttagctccaacggggaagactggatcaccataaaagaaggaaacaaacctgttctctttcagggaaacaccaaccccacagatgttgtggttgcagtattccccaaaccactgataactcgatttgtccgaatcaagcctgcaacttgggaaactggcatatctatgagatttgaagtatacggttgcaagataacagattatccttgctctggaatgttgggtatggtgtctggacttatttctgactcccagatcacatcatccaaccaaggagacagaaactggatgcctgaaaacatccgcctggtaaccagtcgctctggctgggcacttccacccgcacctcattcctacatcaatgagtggctccaaatagacctgggggaggagaagatcgtgaggggcatcatcattcagggtgggaagcaccgagagaacaaggtgttcatgaggaagttcaagatcgggtacagcaacaacggctcggactggaagatgatcatggatgacagcaaacgcaaggcgaagtcttttgagggcaacaacaactatgatacacctgagctgcggacttttccagctctctccacgcgattcatcaggatctaccccgagagagccactcatggcggactggggctcagaatggagctgctgggctgtgaagtggaagcccctacagctggaccgaccactcccaacgggaacttggtggatgaatgtgatgacgaccaggccaactgccacagtggaacaggtgatgacttccagctcacaggtggcaccactgtgctggccacagaaaagcccacggtcatagacagcaccatacaatcagagtttccaacatatggttttaactgtgaatttggctggggctctcacaagaccttctgccactgggaacatgacaatcacgtgcagctcaagtggagtgtgttgaccagcaagacgggacccattcaggatcacacaggagatggcaacttcatctattcccaagctgacgaaaatcagaagggcaaagtggctcgcctggtgagccctgtggtttattcccagaactctgcccactgcatgaccttctggtatcacatgtctgggtcccacgtcggcacactcagggtcaaactgcgctaccagaagccagaggagtacgatcagctggtctggatggccattggacaccaaggtgaccactggaaggaagggcgtgtcttgctccacaagtctctgaaactttatcaggtgattttcgagggcgaaatcggaaaaggaaaccttggtgggattgctgtggatgacattagtattaataaccacatttcacaagaagattgtgcaaaaccagcagacctggataaaaagaacccagaaattaaaattgatgaaacagggagcacgccaggatacgaaggtgaaggagaaggtgacaagaacatctccaggaagccaggcaatgtgttgaagaccttagaacccatcctcatcaccatcatagccatgagcgccctgggggtcctcctgggggctgtctgtggggtcgtgctgtactgtgcctgttggcataatgggatgtcagaaagaaacttgtctgccctggagaactataactttgaacttgtggatggtgtgaagttgaaaaaagacaaactgaatacacagagtacttattcggaggcatga

SEQ ID NO: 45 - DNA, 9312 bp, Homo sapiens
atgccgccgctcctggcgcccctgctctgcctggcgctgctgcccgcgctcgccgcacgaggcccgcgatgctcccagcccggtgagacctgcctgaatggcgggaagtgtgaagcggccaatggcacggaggcctgcgtctgtggcggggccttcgtgggcccgcgatgccaggaccccaacccgtgcctcagcaccccctgcaagaacgccgggacatgccacgtggtggaccgcagaggcgtggcagactatgcctgcagctgtgccctgggcttctctgggcccctctgcctgacacccctggacaatgcctgcctcaccaacccctgccgcaacgggggcacctgcgacctgctcacgctgacggagtacaagtgccgctgcccgcccggctggtcagggaaatcgtgccagcaggctgacccgtgcgcctccaacccctgcgccaacggtggccagtgcctgcccttcgaggcctcctacatctgccactgcccacccagcttccatggccccacctgccggcaggatgtcaacgagtgtggccagaagcccgggctttgccgccacggaggcacctgccacaacgaggtcggctcctaccgctgcgtctgccgcgccacccacactggccccaactgcgagcggccctacgtgccctgcagcccctcgccctgccagaacgggggcacctgccgccccacgggcgacgtcacccacgagtgtgcctgcctgccaggcttcaccggccagaactgtgaggaaaatatcgacgattgtccaggaaacaactgcaagaacgggggtgcctgtgtggacggcgtgaacacctacaactgccgctgcccgccagagtggacaggtcagtactgtaccgaggatgtggacgagtgccagctgatgccaaatgcctgccagaacggcgggacctgccacaacacccacggtggctacaactgcgtgtgtgtcaacggctggactggtgaggactgcagcgagaacattgatgactgtgccagcgccgcctgcttccacggcgccacctgccatgaccgtgtggcctccttctactgcgagtgtccccatggccgcacaggtctgctgtgccacctcaacgacgcatgcatcagcaacccctgtaacgagggctccaactgcgacaccaaccctgtcaatggcaaggccatctgcacctgcccctcggggtacacgggcccggcctgcagccaggacgtggatgagtgctcgctgggtgccaacccctgcgagcatgcgggcaagtgcatcaacacgctgggctccttcgagtgccagtgtctgcagggctacacgggcccccgatgcgagatcgacgtcaacgagtgcgtctcgaacccgtgccagaacgacgccacctgcctggaccagattggggagttccagtgcatctgcatgcccggctacgagggtgtgcactgcgaggtcaacacagacgagtgtgccagcagcccctgcctgcacaatggccgctgcctggacaagatcaatgagttccagtgcgagtgccccacgggcttcactgggcatctgtgccagtacgatgtggacgagtgtgccagcaccccctgcaagaatggtgccaagtgcctggacggacccaacacttacacctgtgtgtgcacggaagggtacacggggacgcactgcgaggtggacatcgatgagtgcgaccccgacccctgccactacggctcctgcaaggacggcgtcgccaccttcacctgcctctgccgcccaggctacacgggccaccactgcgagaccaacatcaacgagtgctccagccagccctgccgccacgggggcacctgccaggaccgcgacaacgcctacctctgcttctgcctgaaggggaccacaggacccaactgcgagatcaacctggatgactgtgccagcagcccctgcgactcgggcacctgtctggacaagatcgatggctacgagtgtgcctgtgagccgggctacacagggagcatgtgtaacatcaacatcgatgagtgtgcgggcaacccctgccacaacgggggcacctgcgaggacggcatcaatggcttcacctgccgctgccccgagggctaccacgaccccacctgcctgtctgaggtcaatgagtgcaacagcaacccctgcgtccacggggcctgccgggacagcctcaacgggtacaagtgcgactgtgaccctgggtggagtgggaccaactgtgacatcaacaacaatgagtgtgaatccaacccttgtgtcaacggcggcacctgcaaagacatgaccagtggctacgtgtgcacctgccgggagggcttcagcggtcccaactgccagaccaacatcaacgagtgtgcgtccaacccatgtctgaaccagggcacgtgtattgacgacgttgccgggtacaagtgcaactgcctgctgccctacacaggtgccacgtgtgaggtggtgctggccccgtgtgcccccagcccctgcagaaacggcggggagtgcaggcaatccgaggactatgagagcttctcctgtgtctgccccacgggctggcaagcagggcagacctgtgaggtcgacatcaacgagtgcgttctgagcccgtgccggcacggcgcatcctgccagaacacccacggcggctaccgctgccactgccaggccggctacagtgggcgcaactgcgagaccgacatcgacgactgccggcccaacccgtgtcacaacgggggctcctgcacagacggcatcaacacggccttctgcgactgcctgcccggcttccggggcactttctgtgaggaggacatcaacgagtgtgccagtgacccctgccgcaacggggccaactgcacggactgcgtggacagctacacgtgcacctgccccgcaggcttcagcgggatccactgtgagaacaacacgcctgactgcacagagagctcctgcttcaacggtggcacctgcgtggacggcatcaactcgttcacctgcctgtgtccacccggcttcacgggcagctactgccagcacgatgtcaatgagtgcgactcacagccctgcctgcatggcggcacctgtcaggacggctgcggctcctacaggtgcacctgcccccagggctacactggccccaactgccagaaccttgtgcactggtgtgactcctcgccctgcaagaacggcggcaaatgctggcagacccacacccagtaccgctgcgagtgccccagcggctggaccggcctttactgcgacgtgcccagcgtgtcctgtgaggtggctgcgcagcgacaaggtgttgacgttgcccgcctgtgccagcatggagggctctgtgtggacgcgggcaacacgcaccactgccgctgccaggcgggctacacaggcagctactgtgaggacctggtggacgagtgctcacccagcccctgccagaacggggccacctgcacggactacctgggcggctactcctgcaagtgcgtggccggctaccacggggtgaactgctctgaggagatcgacgagtgcctctcccacccctgccagaacgggggcacctgcctcgacctccccaacacctacaagtgctcctgcccacggggcactcagggtgtgcactgtgagatcaacgtggacgactgcaatccccccgttgaccccgtgtcccggagccccaagtgctttaacaacggcacctgcgtggaccaggtgggcggctacagctgcacctgcccgccgggcttcgtgggtgagcgctgtgagggggatgtcaacgagtgcctgtccaatccctgcgacgcccgtggcacccagaactgcgtgcagcgcgtcaatgacttccactgcgagtgccgtgctggtcacaccgggcgccgctgcgagtccgtcatcaatggctgcaaaggcaagccctgcaagaatgggggcacctgcgccgtggcctccaacaccgcccgcgggttcatctgcaagtgccctgcgggcttcgagggcgccacgtgtgagaatgacgctcgtacctgcggcagcctgcgctgcctcaacggcggcacatgcatctccggcccgcgcagccccacctgcctgtgcctgggccccttcacgggccccgaatgccagttcccggccagcagcccctgcctgggcggcaacccctgctacaaccaggggacctgtgagcccacatccgagagccccttctaccgttgcctgtgccccgccaaattcaacgggctcttgtgccacatcctggactacagcttcgggggtggggccgggcgcgacatccccccgccgctgatcgaggaggcgtgcgagctgcccgagtgccaggaggacgcgggcaacaaggtctgcagcctgcagtgcaacaaccacgcgtgcggctgggacggcggtgactgctccctcaacttcaatgacccctggaagaactgcacgcagtctctgcagtgctggaagtacttcagtgacggccactgtgacagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagagtgagaccgtggagccgcccccgccggcgcagctgcacttcatgtacgtggcggcggccgcctttgtgcttctgttcttcgtgggctgcggggtgctgctgtcccgcaagcgccggcggcagcatggccagctctggttccctgagggcttcaaagtgtctgaggccagcaagaagaagcggcgggagcccctcggcgaggactccgtgggcctcaagcccctgaagaacgcttcagacggtgccctcatggacgacaaccagaatgagtggggggacgaggacctggagaccaagaagttccggttcgaggagcccgtggttctgcctgacctggacgaccagacagaccaccggcagtggactcagcagcacctggatgccgctgacctgcgcatgtctgccatggcccccacaccgccccagggtgaggttgacgccgactgcatggacgtcaatgtccgcgggcctgatggcttcaccccgctcatgatcgcctcctgcagcgggggcggcctggagacgggcaacagcgaggaagaggaggacgcgccggccgtcatctccgacttcatctaccagggcgccagcctgcacaaccagacagaccgcacgggcgagaccgccttgcacctggccgcccgctactcacgctctgatgccgccaagcgcctgctggaggccagcgcagatgccaacatccaggacaacatgggccgcaccccgctgcatgcggctgtgtctgccgacgcacaaggtgtcttccagatcctgatccggaaccgagccacagacctggatgcccgcatgcatgatggcacgacgccactgatcctggctgcccgcctggccgtggagggcatgctggaggacctcatcaactcacacgccgacgtcaacgccgtagatgacctgggcaagtccgccctgcactgggccgccgccgtgaacaatgtggatgccgcagttgtgctcctgaagaacggggctaacaaagatatgcagaacaacagggaggagacacccctgtttctggccgcccgggagggcagctacgagaccgccaaggtgctgctggaccactttgccaaccgggacatcacggatcatatggaccgcctgccgcgcgacatcgcacaggagcgcatgcatcacgacatcgtgaggctgctggacgagtacaacctggtgcgcagcccgcagctgcacggagccccgctggggggcacgcccaccctgtcgcccccgctctgctcgcccaacggctacctgggcagcctcaagcccggcgtgcagggcaagaaggtccgcaagcccagcagcaaaggcctggcctgtggaagcaaggaggccaaggacctcaaggcacggaggaagaagtcccaggacggcaagggctgcctgctggacagctccggcatgctctcgcccgtggactccctggagtcaccccatggctacctgtcagacgtggcctcgccgccactgctgccctccccgttccagcagtctccgtccgtgcccctcaaccacctgcctgggatgcccgacacccacctgggcatcgggcacctgaacgtggcggccaagcccgagatggcggcgctgggtgggggcggccggctggcctttgagactggcccacctcgtctctcccacctgcctgtggcctctggcaccagcaccgtcctgggctccagcagcggaggggccctgaatttcactgtgggcgggtccaccagtttgaatggtcaatgcgagtggctgtcccggctgcagagcggcatggtgccgaaccaatacaaccctctgcgggggagtgtggcaccaggccccctgagcacacaggccccctccctgcagcatggcatggtaggcccgctgcacagtagccttgctgccagcgccctgtcccagatgatgagctaccagggcctgcccagcacccggctggccacccagcctcacctggtgcagacccagcaggtgcagccacaaaacttacagatgcagcagcagaacctgcagccagcaaacatccagcagcagcaaagcctgcagccgccaccaccaccaccacagccgcaccttggcgtgagctcagcagccagcggccacctgggccggagcttcctgagtggagagccgagccaggcagacgtgcagccactgggccccagcagcctggcggtgcacactattctgccccaggagagccccgccctgcccacgtcgctgccatcctcgctggtcccacccgtgaccgcagcccagttcctgacgcccccctcgcagcacagctactcctcgcctgtggacaacacccccagccaccagctacaggtgcctgagcaccccttcctcaccccgtcccctgagtcccctgaccagtggtccagctcgtccccgcattccaacgtctccgactggtccgagggcgtctccagccctcccaccagcatgcagtcccagatcgcccgcattccggaggccttcaagtaaacggcgcgccccacgagaccccggcttcctttcccaagccttcgggcgtctgtgtgcgctctgtggatgccagggccgaccagaggagcctttttaaaacacatgtttttatacaaaataagaacgaggattttaattttttttagtatttatttatgtacttttattttacacagaaacactgcctttttatttatatgtactgttttatctggccccaggtagaaacttttatctattctgagaaaacaagcaagttctgagagccagggttttcctacgtaggatgaaaagattcttctgtgtttataaaatataaacaaagattcatgatttataaatgccatttatttattgattccttttttcaaaatccaaaaagaaatgatgttggagaagggaagttgaacgagcatagtccaaaaagctcctggggcgtccaggccgcgccctttccccgacgcccacccaaccccaagccagcccggccgctccaccagcatcacctgcctgttaggagaagctgcatccagaggcaaacggaggcaaagctggctcaccttccgcacgcggattaatttgcatctgaaataggaaacaagtgaaagcatatgggttagatgttgccatgtgttttagatggtttcttgcaagcatgcttgtgaaaatgtgttctcggagtgtgtatgccaagagtgcacccatggtaccaatcatgaatctttgtttcaggttcagtattatgtagttgttcgttggttatacaagttcttggtccctccagaaccaccccggccccctgcccgttcttgaaatgtaggcatcatgcatgtcaaacatgagatgtgtggactgtggcacttgcctgggtcacacacggaggcatcctacccttttctggggaaagacactgcctgggctgaccccggtggcggccccagcacctcagcctgcacagtgtcccccaggttccgaagaagatgctccagcaacacagcctgggccccagctcgcgggacccgaccccccgtgggctcccgtgttttgtaggagacttgccagagccgggcacattgagctgtgcaacgccgtgggctgcgtcctttggtcctgtccccgcagccctggcagggggcatgcggtcgggcaggggctggagggaggcgggggctgcccttgggccacccctcctagtttgggaggagcagatttttgcaataccaagtatagcctatggcagaaaaaatgtctgtaaatatgtttttaaaggtggattttgtttaaaaaatcttaatgaatgagtctgttgtgtgtcatgccagtgagggacgtcagacttggctcagctcggggagccttagccgcccatgcactggggacgctccgctgccgtgccgcctgcactcctcagggcagcctcccccggctctacgggggccgcgtggtgccatccccagggggcatgaccagatgcgtcccaagatgttgatttttactgtgttttataaaatagagtgtagtttacagaaaaagactttaaaagtgatctacatgaggaactgtagatgatgtatttttttcatcttttttgttaactgatttgcaataaaaatgatactgatggtgaaaaaaaaaaaaaaa

SEQ ID NO: 46 - DNA, 2391 bp, Homo sapiens
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccaacgtgaggctgagctgctcaccatgctgcagcaccagcacatcgtgcgcttcttcggcgtctgcaccgagggccgccccctgctcatggtcttcgagtatatgcggcacggggacctcaaccgcttcctccgatcccatggacccgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 47 - DNA, 3707 bp, Homo sapiens
cccccattcgcatctaacaaggaatctgcgccccagagagtcccggacgccgccggtcggtgcccggcgcgccgggccatgcagcgacggccgccgcggagctccgagcagcggtagcgcccccctgtaaagcggttcgctatgccgggaccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttcttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggctt

SEQ ID NO: 48 - DNA, 2860 bp, Homo sapiens
gatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacaggctctttaatccatctggaaatgatttttgtatatggtgtgaggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 49 - DNA, 1413 bp, Homo sapiens
atgtgcctactggagtctctggactgtttcttgaccgtcacacccatctctccctttcttcctggaggagcacttgacaaagagaggacccctccacctaccttgagtaatggccacaggaaacaagatttctctttatttgttatgcttgagtttcagagaaccctggtaaagctgcattcaactctgcagttaggctggagaaatgagacagaacaccagctaatgaaagagttaagcgtgaagtgcttcatgcacagagcaacagatgctcaacaaatcagtgatgaaatccaaggatgggccctaagtgatactgcatttggtattctgagaaagcttgtttataaaagcctaaaaggcttccttgctttcccccaagccagatatttgccaaatggcataggtcagaggtgcaaagttggttttgtcttagcaaggcaagagaatccactagcggactcacccttaccggagctgctgcggcccgactgccccgagcccgcgggcttggacgcgacacgggaggggcccgatcggaacttccgactgagcgagcaccgccaggccctggccgccgccaagcaccgaggccccgcggcgaccccggggagccccgatcccggccccggtccgtggggcgaagagcacttggcggagaggggccccaggggctgggagaggggcggcgatcgctgcgacgcgcccggtggggacgcggcgcggaggcccgacccagaggccgaggcaccccccgccgggagcatcgaggccgccccgagtagtgcggcggagccggtgatcgtctccaggtcggatcccagagacgagaagctggccctatacctggccgaggtggagaagcaggacaagtatctgcggcagaggaataagtaccgattccacatcattccagacggcaactgcctctaccgagctgtcagcaagacggtgtatggggaccagagcctgcaccgggagttgagggagcagacggtgcactacatcgccgaccatctcgaccacttcagccccctgattgagggcgacgtgggggagtttatcatcgctgctgcccaagacggggcatgggccgggtacccggagttgctggccatggggcagatgctgaatgtgaatatccatttaactactggagggaggctggagagtcccacggtgtctaccatgattcattatttgggcccagaggattccctgaggcctagtatttggctcagttggctcagtaacggacactatgatgctgtatttgatcactcctatcctaacccagagtacgacaactggtgcaaacaaactcaagtgcaaaggaaacgcgacgaagaacttgccaaatctatggccatatccttgtctaaaatgtatattgaacaaaatgcatgctcttga

SEQ ID NO: 50 - DNA, 3889 bp, Homo sapiens
gtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcccaaaaaaaaaaaaaaaaaaaa

SEQ ID NO: 51 - DNA, 5598 bp, Homo sapiens
ggcccctcagccctgctgcccagcacgagcctgtgctcgccctgcccaacgcagacagccagacccagggcggcccctctggcggctctgctcctcccgaaggatgcttggggagtgaggcgaagctgggcgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcactttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagccccaagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatggtaccccaagaaggatgtgagaggtggccgcttggagtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcac

SEQ ID NO: 52 - DNA, 4576 bp, Homo sapiens
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaa

SEQ ID NO: 53 - DNA, 3724 bp, Homo sapiens
tctccctcggcgccgccgccgccgcccgcggggctgggacccgatgcggttagagccgcggagcctggaagagccccgagcgtttctgctttgggacaaccatacatctaattccttaaagtagttttatatgtaaaacttgcaaagaatcagaacaatgcctccacgaccatcatcaggtgaactgtggggcatccacttgatgcccccaagaatcctagtagaatgtttactaccaaatggaatgatagtgactttagaatgcctccgtgaggctacattaataaccataaagcatgaactatttaaagaagcaagaaaataccccctccatcaacttcttcaagatgaatcttcttacattttcgtaagtgttactcaagaagcagaaagggaagaattttttgatgaaacaagacgactttgtgaccttcggctttttcaaccctttttaaaagtaattgaaccagtaggcaaccgtgaagaaaagatcctcaatcgagaaattggttttgctatcggcatgccagtgtgtgaatttgatatggttaaagatccagaagtacaggacttccgaagaaatattctgaacgtttgtaaagaagctgtggatcttagggacctcaattcacctcatagtagagcaatgtatgtctatcctccaaatgtagaatcttcaccagaattgccaaagcacatatataataaattagataaagggcaaataatagtggtgatctgggtaatagtttctccaaataatgacaagcagaagtatactctgaaaatcaaccatgactgtgtaccagaacaagtaattgctgaagcaatcaggaaaaaaactcgaagtatgttgctatcctctgaacaactaaaactctgtgttttagaatatcagggcaagtatattttaaaagtgtgtggatgtgatgaatacttcctagaaaaatatcctctgagtcagtataagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataagatctatgttcgaacaggtatctaccatggaggagaacccttatgtgacaatgtgaacactcaaagagtaccttgttccaatcccaggtggaatgaatggctgaattatgatatatacattcctgatcttcctcgtgctgctcgactttgcctttccatttgctctgttaaaggccgaaagggtgctaaagaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagaaactccatgcttagagttggagtttgactggttcagcagtgtggtaaagttcccagatatgtcagtgattgaagagcatgccaattggtctgtatcccgagaagcaggatttagctattcccacgcaggactgagtaacagactagctagagacaatgaattaagggaaaatgacaaagaacagctcaaagcaatttctacacgagatcctctctctgaaatcactgagcaggagaaagattttctatggagtcacagacactattgtgtaactatccccgaaattctacccaaattgcttctgtctgttaaatggaattctagagatgaagtagcccagatgtattgcttggtaaaagattggcctccaatcaaacctgaacaggctatggaacttctggactgtaattacccagatcctatggttcgaggttttgctgttcggtgcttggaaaaatatttaacagatgacaaactttctcagtatttaattcagctagtacaggtcctaaaatatgaacaatatttggataacttgcttgtgagatttttactgaagaaagcattgactaatcaaaggattgggcactttttcttttggcatttaaaatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtacagatgaagtttttagttgagcaaatgaggcgaccagatttcatggatgctctacagggctttctgtctcctctaaaccctgctcatcaactaggaaacctcaggcttgaagagtgtcgaattatgtcctctgcaaaaaggccactgtggttgaattgggagaacccagacatcatgtcagagttactgtttcagaacaatgagatcatctttaaaaatggggatgatttacggcaagatatgctaacacttcaaattattcgtattatggaaaatatctggcaaaatcaaggtcttgatcttcgaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatatatgatgcagccattgacctgtttacacgttcatgtgctggatactgtgtagctaccttcattttgggaattggagatcgtcacaatagtaacatcatggtgaaagacgatggacaactgtttcatatagattttggacactttttggatcacaagaagaaaaaatttggttataaacgagaacgtgtgccatttgttttgacacaggatttcttaatagtgattagtaaaggagcccaagaatgcacaaagacaagagaatttgagaggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaaaaaaaaaaaaaa

SEQ ID NO: 54 - DNA, 6453 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaaaaaaaaaaaaaaaaaa

SEQ ID NO: 55 - DNA, 3953 bp, Homo sapiens
ggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggcccgccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcccccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtcgaaaaaaaaaaaaaaa

SEQ ID NO: 56 - DNA, 5078 bp, Homo sapiens
acttccgctcggcgacaggaagtgaggtcagaccggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaaaaaaaaaaaaaaaaaaaaaaaaaaaaaaaaaaaaa

SEQ ID NO: 57 - DNA, 3255 bp, Homo sapiens
aagcttactcagcgcatctgctacagcattttatcttcccaagagccccatgaggcgatgacccaggatgcagccaggggccacgacatgcacggaggaccgcatccagcatgccctggaacgctgcctgcatggactcagcctcagccgccgctccacctcctggtcagctgggctgtgtctgaactgctggagcctgcaggagctggtcagcagggacccgggccacttccttatcctccttgagcagatcctgcagaagacccgagaggtccaggagaagggcacctacgacctgctcaccccgctggccctgctcttctattccactgttctttgtacaccacacttcccaccagactcggatctccttctgaaggcagccagcacctaccaccggttcctgacctggcctgttccttactgcagcatctgccaggagctgctcaccttcattgatgctgaactcaaggccccagggatctcctaccagagactggtgagggctgagcagggcctgcccatcaggagtcaccgcagctccaccgtcaccgtgctgctgctgaacccagtggaagtgcaggccgagttccttgctgtagccaataagctgagtacgcccggacactcgcctcacagtgcctacaccaccctgctcctgcacgccttccaggccacctttggggcccactgtgacgtcccgggcctgcactgcaggctacaggccaagaccctggcagagcttgaggacatcttcacggagaccgcagaggcacaggagctggcatctggcatcggggatgctgcagaggcccggcggtggctcaggaccaagctgcaggcggtgggagaaaaagctggcttccctggggtgttagacactgcaaaaccagggaagctccacaccatccccatccctgtcgccaggtgctacacctacagctggagccaggacagctttgacatcctgcaggaaatcctgctcaaggaacaggagctactccagccagggatcctgggagatgatgaagaggaggaagaggaggaggaggaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggcatggacagcggctacgtggaggacagcgaggagagctcctccgagtggccttggaggcgtggcagccaggaacgccgaggccaccgcaggcctgggcagaagttcatcaggatctataaactcttcaagagcaccagccagctggtactgcggagggactctcggagcctggagggcagctcggacacggccctgcccctgaggcgggcagggagcctctgcagccccctggacgaaccagtatcacccccttcccgggcccagcgctcccgctccctgccccagcccaaactcggtacccagctgcccagctggcttctggcccctgcttcacgcccccagcgccgccgccccttcctgagtggagatgaggatcccaaggcttccacgctacgtgttgtggtctttggctccgatcggatttcagggaaggtggctcgggcgtacagcaaccttcggcggctggagaacaatcgcccactcctcacacggttcttcaaacttcagttcttctacgtgcctgtgaagcgaagtcatgggaccagccctggtgcctgtccaccccctcggagccagacgccctcacccccgacagactcccctaggcacgccagccctggagagctgggcaccaccccatgggaggagagcaccaatgacatctcccactacctcggcatgctggacccctggtatgagcgcaatgtactgggcctcatgcacctgccccctgaagtcctgtgccagcagtccctgaaggctgaagcccaggccctggagggctccccaacccagctgcccatcctggctgacatgctactctactactgccgctttgccgccagaccggtgctgctgcaactctatcagaccgagctgaccttcatcactggggagaagacgacagagatcttcatccactccttggagctgggtcactccgctgccacacgtgccatcaaggcgtcaggtcctggcagcaagcggctgggcatcgatggcgaccgggaggctgttcctctaacactacagattatttacagcaagggggccatcagtggacgaagtcgctggagcaacctggagaaggtctgtacctccgtgaacctcaacaaggcctgccggaagcaggaggagctggattccagcatggaggccctgacgctaaacctgacagaagtggtgaaaaggcagaactccaaatccaagaagggctttaaccagattagcacatcgcagatcaaagtggacaaggtgcagatcatcggctccaacagctgcccctttgctgtgtgcctggaccaggatgagagaaagatcctgcagagtgtagtcagatgtgaggtctcaccgtgctacaagccagagaagagcgacctctcctcaccaccccagacgcctcctgacctgccggcccaggccgcacctgatctctgctcccttctctgcctgcccatcatgactttcagtggagctctgccctagtgtgggcccagcgccagactggacagaagccctggggcaacctcctcggccacccctccaggacagtccctctctgtggagaactgaatggccctgtgcagagccatagtcccactgtgggtcctgcaatgagcaggggctgggagtagagggtttctggggcctcagggttctgggaaagcaacagctatcagagagagaagggccagaccccatagcctcttagattcctggcagtagaaggagaaggatgggtaaattgacctctgaagtccctgaccattagcatggtctaggatcctttctagaaggaagatctgaggctctggtgctcagggggatggcttgggccttttctctcaaccttggctgagcctaccccttactttgccaaagacttgaggaccctgtatgtctggagttcagtcccctcctctgtggggctcaggtgattgaaatgtggatgaaacatttctctacttcaagaccacctctccctgcaaacaccacacacacatggcatgcatgtacgcacatgcgcaccg

SEQ ID NO: 58 - DNA, 2204 bp, Homo sapiens
gagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggaggtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtataccttgttagtgggcaaaccaccttttgagacttcttgcctaaaagagacctacctccggatcaagaagaatgaatacagtattcccaagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaagaggaggctgaggatcctgcctgcatccccatcttctgggtcagcaagtgggtggactattcggacaagtacggccttgggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtgtaagttatttttgtacatgttcgggtgtgggttctacagccttgtccccctccccctcaaccccaccatatgaattgtacagaatatttctattgaattcggaactgtcctttccttggctttatgcacattaaacagatgtgaatattcaaaaaaaaaaaaaaaaaaaaaaaaaaaaaaaaaaa

SEQ ID NO: 59 - DNA, 2574 bp, Homo sapiens
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagaggcctttcttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagcttcggaattc

SEQ ID NO: 60 - DNA, 4878 bp, Homo sapiens
tcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccaaaaa

SEQ ID NO: 61 - DNA, 6825 bp, Homo sapiens
gcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggcagtggaaattggaacatttgtgttacaaatcaggagagcttatcacagaaacaggttacatggatcagataatagaatatctttacccttgtttgattattacacctttggactgcttctgggaaggggcgaaattacagtctgggacagcatacctcctaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaacctcttgatatggcccttgttttgaatggtggatgtcatggcttatccagaaagtatatgcactggcaggaggagttgattgtgggtggcacagtcaagaacagcactggaaaactcgtcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtggttcatcagagtgtcgcacagaactccactcaaaaggtgctttccttcaccaccacgaccctggacgacatcctgaaatccttctctgacgtcagtgtcatccgcgtggccagcggctacttactcatgctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggttttgccatttctcgctcttggtgttggtgtggatgatgtttttcttctggcccacgccttcagtgaaacaggacagaataaaagaatcccttttgaggacaggaccggggagtgcctgaagcgcacaggagccagcgtggccctcacgtccatcagcaatgtcacagccttcttcatggccgcgttaatcccaattcccgctctgcgggcgttctccctccaggcagcggtagtagtggtgttcaattttgccatggttctgctcatttttcctgcaattctcagcatggatttatatcgacgcgaggacaggagactggatattttctgctgttttacaagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaatcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtatttctttgctgtgctggcgatcctcaccatcctcggcgttctcaatgggctggttttgcttcccgtgcttttgtctttctttggaccatatcctgaggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtggtccatcccgaatccaggcatcacccaccctcgaacccgagacagcagccccacctggactcagggtccctgcctcccggacggcaaggccagcagccccgcagggacccccccagagaaggcttgtggccacccctctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaaaaaaa

SEQ ID NO: 62 - DNA, 3413 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccgggctcaggcgagggagatgagagacggcggcggccgcggcccggagcccctctcagcgcctgtgagcagccgcgggggcagcgccctcggggagccggccggcctgcggcggcggcagcggcggcgtttctcgcctcctcttcgtcttttctaaccgtgcagcctcttcctcggcttctcctgaaagggaaggtggaagccgtgggctcgggcgggagccggctgaggcgcggcggcggcggcggcacctcccgctcctggagcgggggggagaagcggcggcggcggcggccgcggcggctgcagctccagggagggggtctgagtcgcctgtcaccatttccagggctgggaacgccggagagttggtctctccccttctactgcctccaacacggcggcggcggcggcggcacatccagggacccgggccggttttaaacctcccgtccgccgccgccgcaccccccgtggcccgggctccggaggccgccggcggaggcagccgttcggaggattattcgtcttctccccattccgctgccgccgctgccaggcctctggctgctgaggagaagcaggcccagtcgctgcaaccatccagcagccgccgcagcagccattacccggctgcggtccagagccaagcggcggcagagcgaggggcatcagctaccgccaagtccagagccatttccatcctgcagaagaagccccgccaccagcagcttctgccatctctctcctcctttttcttcagccacaggctcccagacatgacagccatcatcaaagagatcgttagcagaaacaaaaggagatatcaagaggatggattcgacttagacttgacctatatttatccaaacattattgctatgggatttcctgcagaaagacttgaaggcgtatacaggaacaatattgatgatgtagtaaggtttttggattcaaagcataaaaaccattacaagatatacaatctttgtgctgaaagacattatgacaccgccaaatttaattgcagagttgcacaatatccttttgaagaccataacccaccacagctagaacttatcaaacccttttgtgaagatcttgaccaatggctaagtgaagatgacaatcatgttgcagcaattcactgtaaagctggaaagggacgaactggtgtaatgatatgtgcatatttattacatcggggcaaatttttaaaggcacaagaggccctagatttctatggggaagtaaggaccagagacaaaaagggagtaactattcccagtcagaggcgctatgtgtattattatagctacctgttaaagaatcatctggattatagaccagtggcactgttgtttcacaagatgatgtttgaaactattccaatgttcagtggcggaacttatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccg

SEQ ID NO: 63 - DNA, 4740 bp, Homo sapiens
ttccggtttttctcaggggacgttgaaattatttttgtaacgggagtcgggagaggacggggcgtgccccgcgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcacgagttgacctagatgagatgtcgttcactttactgagctacagaaaaacatacgaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatcgaagattatttttggatcatgataaaactcttcagactgattctatagacagttttgaaacacagagaacaccacgaaaaagtaaccttgatgaagaggtgaatataattcctccacacactccagttaggactgttatgaacactatccaacaattaatgatgattttaaattctgcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgagtcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtc

SEQ ID NO: 64 - DNA, 1876 bp, Homo sapiens
gagggtgctgcgagctgctgggctgcacacgcacacgcacacgcacacgcacactgatgcacacggacctggacacagacatggacatggacacagaaaccacagcactctgcccctctggcagccgccgggcctcccctccagggacgcccacaccagaagcagatgccacgctactaaagaagtcagagaaactgttggcagagttggaccggagcgggttaccctctgcccctggggcccccagacgaagaggcagtatgcctgtcccctacaagcaccagctccggcgggcccaggctgtagatgaacttgactggccacctcaggcctcatcctctggctcgtctgactccttgggctcaggggaggcagcccctgctcaaaaggatggcatcttcaaggtcatgctagtgggggagagcggcgtgggcaagagcaccctagcaggcacttttggtggtctccagggagacagtgctcacgaaccggagaacccagaggatacctatgagagacgcatcatggtggataaggaggaagtgactctagtcgtttatgacatctgggaacagggggatgcaggagggtggctgcgggaccactgccttcagaccggggacgcctttctcatcgtcttctcagtcaccgaccgacggagtttctccaaagttccagagaccctacttcggctccgggctgggaggccgcaccacgacctacccgttatcctcgttggaaacaagagcgacttggcccgctcccgggaggtatcactggaggagggccgccacctggccgggacgctgagctgcaagcacatcgagacgtcggccgcactgcaccacaacacgagggagctcttcgagggcgcggtgcgccagatccggctgcggcggggccgaaaccacgccggaggccagaggcccgatccgggcagccccgagggccctgcgccacctgcacgccgcgagagcctcaccaagaaagccaagaggttcctcgccaacctggtgccgcgcaacgccaagttcttcaagcagcgctccaggtcgtgtcacgacctctcggtgctctgagccgcggtcgccatggccactgcggtcgccatggtcaccgcgccctccgctcgccccccctcgccccgccccgcccccgtccggcttccttggtggaggccgtctaggaaaccaaaaactcccaggatgccccggtgtgaccgccgggggcggcccggggccgctcggcggcacctccacacccgccccaacgcgttctctggagctttgggcctcagggcgcctagaaggcgaggacgcagacctgaaggcggccggtgagcggggcgggttctgctgggtcgggaagaaaaataattctgcaaggtattttgttttttattaattcgcgcttggccacctcatctgtaaagagattctaaaagcaagatctggaaaagtgcttcgtagactccttgacggagtttgcctcctttgtacgctgcgtgaacatgcctcacctttaagagagtcttaaaggtaaagacacgaaaacacttcctccagggaccttcccgaaaacgttctggctctcatctggtgcggcatgtgtccactttgcctttaaggagttcttaaaggcaagggcctggaagtgctgttcctgagatggattctcttgacttaccagtccaccacggcacttcccctttaaggttattaaaggtaaggggtggacagactttctgcattcagataatgagcagtggcaaccccttttggccagggccaggggggcaccagcaaggggccaccctttcccttttcaataaataatttttgtactgcctcaaaaaaaaaaaaaaaaaaaaaaaaaa

SEQ ID NO: 65 - DNA, 4161 bp, Homo sapiens
ccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcggccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctctgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggaagtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaatttaaaaaaaaaaaa

SEQ ID NO: 66 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 67 - DNA, 5415 bp, Homo sapiens
gcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccataccgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccaaa

SEQ ID NO: 68 - DNA, 2346 bp, Homo sapiens
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctaaaaaaa

SEQ ID NO: 69 - DNA, 4898 bp, Homo sapiens
cgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggttgggtggcccagaccccttggactatgttagcatgtacaggaatgtggggagcccttctgctaacatccccgagcactggcactacatcagcttcggcctgagtgatctctatggtgacaacagagtccatgagtttacaggaacagatggacctagtggttttggctttgagttgacctttcgtctgaagagagaaactggggagtctgccccaccaacatggcccgcagagttaatgcagggcttggcacgatacgtgttccagtcagagaacaccttctgcagtggggaccatgtgtcctggcacagccctttggataacagtgagtcaagaattcagcacatgctgctgacagaggacccacagatgcagcccgtgcagacaccctttggggtagttaccttcctccagatcgttggtgtctgcactgaagagctacactcagcccagcagtggaacgggcagggcatcctggagctgctgcggacagtgcctattgctggcggcccctggctgataactgacatgcggaggggagagaccatatttgagatcgatccacacctgcaagagagagttgacaaaggcatcgagacagatggctccaacctgagtggtgtcagtgccaagtgtgcctgggatgacctgagccggccccccgaggatgacgaggacagccggagcatctgcatcggcacacagccccggcgactctctggcaaagacacagagcagatccgggagaccctgaggagaggactcgagatcaacagcaaacctgtccttccaccaatcaaccctcagcggcagaatggcctcgcccacgaccgggccccgagccgcaaagacagcctggaaagtgacagctccacggccatcattccccatgagctgattcgcacgcggcagcttgagagcgtacatctgaaattcaaccaggagtccggagccctcattcctctctgcctaaggggcaggctcctgcatggacggcactttacatataaaagtatcacaggtgacatggccatcacgtttgtctccacgggagtggaaggcgcctttgccactgaggagcatccttacgcggctcatggaccctggttacaaattctgttgaccgaagagtttgtagagaaaatgttggaggatttagaagatttgacttctccagaggaattcaaacttcccaaagagtacagctggcctgaaaagaagctgaaggtctccatcctgcctgacgtggtgttcgacagtccgctacactagcctgggctgggccctgcaggggccagcagggagcccagctgctccccagtgacttccagtgtaacagttgtgtcaacgagatctccacaaataaaaggacaagtgtgaggaagactgcgcagtgccaccccgcagcccagtggggtgccatgcacaggccacaggccctccacctcacctccagctcaggggccgcaccccgccgctggctaagccttgtgacccatcaggccagtgagtgggcaaatgcggaccctccctgcctgcagcctgcacagattctggtttgaggtttgactctggaccctggctgtgcccctaggtggagacagccctctttctcacctaccccctgccgcacagcccagcaggagggaggcggacagccagatgcagagcgagtggatgcacttcccagctcatctctggaagcctttgctactcaagctcctctggccgcggaacaattcctctgatcatgtttggttttcttcttccttattttattttgtagaaaccgggtggtattttattgctctgcaaagatgtccagaagccatgtatataatgttttttaaacagaacttcattccccgttgaactttcgcattctctgacagaggcctagggctgtatctctccctgggctgccaccagagaaggtgcttggtgttcgcctgccagcccagagccctggaggagccggctgcacagagaggcttttcttcccagctgggcctgatggagcccggggcagggggagagtagagacactcccttgtgcagctttgagcctagtttagctggggccagggaggggtgctactgttttccaagtgaatgggtctcaaagacttggtgaccccagcctcatcttctaggccttttccatccaaccaggcctacctgggagagggtgaggttcagcacatcacacaccatccccactgtcattcagggcctgggtctccagctctgtaaccagtcctgtcccatttcctcagtccctgggcctcccagccttcaggctgtagggctgccttactaaaattgaaaaatccacctcttaacatctctttcactttggttttgctaacactgctctctgctgccctcccatcctccctgtatccattcatgccctatctttcattctccactcctaatccctctcctttctggcatcctggcctctcgtggtcctcagcccctcacccccagtactgcagatctcacagtttgccttccagaagccagcctatctctagcccatggttttggagttcctctcgggttatctcccacgcctgacctggaaccagcaagcccctttcctgccttcttacccccaactctagggatgggactgttacaatacttcaagatcactctttacacctcttcaaagcaaagtcatgacaatgcagggctcctcattgctcccatctgcctctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcggtgcccctatggggctgaccagtagagaatttcctttactgtatttttgtgtctggtcttccctttctggcttctaggacatccatgccaggtgaggtgcctgggtccctgttacaagtcaggagccctgtagggagacccctccttttgtacaagtacctgaatgctgcgacaagcagatttttgtaaaattttatattagtttttaatgtcagtggcgactcggttcctggggctgcagccagcctgggacttttgtaagaatttttgggtgactcacttagatgtcgtttccttcttgccccctcttcctctctgtaatctaagtgcattaaacatctttgcag

SEQ ID NO: 70 - DNA, 2308 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcagttgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgttt

SEQ ID NO: 71 - DNA, 2090 bp, Homo sapiens
gttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggcccctcctggctggcgagcgggcgccacatctggcccgcacatctgcgctgccggcccggcgcggggtccggagagggcgcggcgcggagcgcagccaggggtccgggaaggcgccgtccgtgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgctgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttatggggcaggctgggcatgtccaaagaggctgcccctctcaccaaa

SEQ ID NO: 72 - DNA, 2629 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggtaggggcccacttcaccgtactaaccagggaagctgtccctcatgttgaattttctctaacttcaaggcccatatctgtgaaatgctggcatttgcacctacctcacagagtgcattgtgagggttaatgaaataatgtacatctggccttgaaaccaccttttattacatggggtctaaaacttgacccccttgagggtgcctgttccctctccctctccctgttggctggtgggttggtagtttctacagttgggcagctggttaggtagagggagttgtcaagtcttgctggcccagccaaaccctgtctgacaacctcttggtcgaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtggagctggaagggtcaacatcttttacattctgcaagcacatctgcattttcaccccacccttcccctccttctccctttttatatcccatttttatatcgatctcttattttacaataaaactttgctgcca

SEQ ID NO: 73 - DNA, 2141 bp, Homo sapiens
atggcggcggccgctgcggcgggacgagtctgggcaacggctgcggctaaagctgcagcggcccacgggggggctgcacgggggtagtagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttccctgcctggctcaccacccccaacagtggctttgcctctcccatctcggaccaacttagcccgttccaagtctgtgagcagtggggacttgcgtccaatggggattgccttgggagggcaccgtgggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccttgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtttttgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaa

SEQ ID NO: 74 - DNA, 8082 bp, Homo sapiens
gacgtttgcttgggagaacattccaggcaaatggaagaacaggtacaaaggcaagcaaggtggctggtgtgaggggagcacagtgagaaagggaaagagtggacaacgctgcagtggaagaagggcttgaggtctcattccacgcttgatggggaggaggtggagtgtagaatggaacataattatagcagaagggaagcctcacgagggcaggggttcttgtctttatgttctctgctgtgttcccagcttctagaacagtgcccagtacctagtagatgttcactcacagttgtttaaatgaataaataaatgaattctctcacaacgtgtttaattttattttacaggctcacagtaatgaaaccatagggagtgtccggtggaaaatagccaagcagttgtgctctcctgtggataatatacagatatttacaaatgatagcctggtaggtttaaataagcagttttgatgaataataaatgatataatataaatatttagcctgatatgaataatttcctcttccttttcctctcaataattaagaaaccactttttgcagctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaaacattgctgtctgaatcaagttctcagtcctcaaaatctccatccctgtcatcaaagcaacagcaccagccaagtgccagttcaattttagaaagtctgtttcgatcttttgccccgggaatgtctaccttcagagtgctctacaacttagaagttctaagctccaaactcatgccaacagctgatgatgacatggccagaagctgtgccaaatccttctgtgaaaacttcctcaaagctggcggtttgagtttggttgtaaatgtcatgcagagagactccatcccatcagaagtagactatgaaacaaggcagggtgtttattccatctgtctacagcttgcaagatttttacttgtcggacaaacaatgcccacgttattagatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaa

SEQ ID NO: 75 - DNA, 4968 bp, Homo sapiens
gcggccgccgtggccctcacagtcggcgtttcgccgcctgcccgcggtgcccgcgcacgccggccgccatcgccttcgcgcctggctggcgggggcgctgtcctcccaggccgtccgcgccgctccctggagctcggcggagcgcggcagccagggccggcggaggcgcgaggagccgggcgccaccgccgccgccgccgccgccgccgcgggggccatgaccgtggagcagaacgtgctgcagcagagcgcggcgcagaagcaccagcagacgtttttgaatcaactgagagaaattacggggattaatgacacccagatactacagcaagccttgaaggatagtaatggaaacttggaattagcagtggctttccttactgcgaagaatgctaagacccctcagcaggaggagacaacttactaccaaacagcacttcctggcaatgatagatacatcagtgtgggaagccaagcagatacaaatgtgattgatctcactggagatgataaagatgatcttcagagagcaattgccttgagtttggccgaatcaaacagggcattcagggagactggaataactgatgaggaacaagccattagcagagttcttgaagccagcatagcagagaataaagcatgtttgaagaggacacctacagaagtttggagggattctcgaaacccttatgatagaaaaagacaggacaaagctcccgttgggctaaagaatgttggcaatacttgttggtttagtgctgttattcagtcattatttaatcttttggaatttagaagattagttctgaattacaagcctccatcaaatgctcaagatttaccccgaaaccaaaaggaacatcggaatttgccttttatgcgtgagctgaggtatctatttgcacttcttgttggtaccaaaaggaagtatgttgatccatcaagagcagttgaaattcttaaggatgctttcaaatcaaatgactcacagcagcaagatgtgagtgagtttacacacaaattattagattggttagaagatgccttccaaatgaaagctgaagaggagacggatgaagagaagccaaagaaccccatggtagagttgttctatggcagattcctggctgtgggagtacttgaaggtaaaaaatttgaaaacactgaaatgtttggtcagtacccacttcaggtcaatgggttcaaagatctgcatgagtgcctagaagctgcaatgattgaaggagaaattgagtctttacattcagagaattcaggaaaatcaggccaagagcattggtttactgaattaccacctgtgttaacatttgaattgtcaagatttgaatttaatcaggcattgggaagaccagaaaaaattcacaacaaattagaatttccccaagttttatatttggacagatacatgcacagaaacagagaaataacaagaattaagagggaagagatcaagagactgaaagattacctcacggtattacaacaaaggctagaaagatatttaagctatggttccggtcccaaacgattccccttggtagatgttcttcagtatgcattggaatttgcctcaagtaaacctgtttgcacttctcctgttgacgatattgacgctagttccccacctagtggttccataccatcacagacattaccaagcacaacagaacaacagggagccctatcttcagaactgccaagcacatcaccttcatcagttgctgccatttcatcgagatcagtaatacacaaaccatttactcagtcccggatacctccagatttgcccatgcatccggcaccaaggcacataacggaggaagaactttctgtgctggaaagttgtttacatcgctggaggacagaaatagaaaatgacaccagagatttgcaggaaagcatatccagaatccatcgaacaattgaattaatgtactctgacaaatctatgatacaagttccttatcgattacatgccgttttagttcacgaaggccaagctaatgctgggcactactgggcatatatttttgatcatcgtgaaagcagatggatgaagtacaatgatattgctgtgacaaaatcatcatgggaagagctagtgagggactcttttggtggttatagaaatgccagtgcatactgtttaatgtacataaatgataaggcacagttcctaatacaagaggagtttaataaagaaactgggcagccccttgttggtatagaaacattaccaccggatttgagagattttgttgaggaagacaaccaacgatttgaaaaagaactagaagaatgggatgcacaacttgcccagaaagctttgcaggaaaagcttttagcgtctcagaaattgagagagtcagagacttctgtgacaacagcacaagcagcaggagacccagaatatctagagcagccatcaagaagtgatttctcaaagcacttgaaagaagaaactattcaaataattaccaaggcatcacatgagcatgaagataaaagtcctgaaacagttttgcagtcggcaattaagttggaatatgcaaggttggttaagttggcccaagaagacaccccaccagaaaccgattatcgtttacatcatgtagtggtctactttatccagaaccaggcaccaaagaaaattattgagaaaacattactagaacaatttggagatagaaatttgagttttgatgaaaggtgtcacaacataatgaaagttgctcaagccaaactggaaatgataaaacctgaagaagtaaacttggaggaatatgaggagtggcatcaggattataggaaattcagggaaacaactatgtatctcataattgggctagaaaattttcaaagagaaagttatatagattccttgctgttcctcatctgtgcttatcagaataacaaagaactcttgtctaaaggcttatacagaggacatgatgaagaattgatatcacattatagaagagaatgtttgctaaaattaaatgagcaagccgcagaactcttcgaatctggagaggatcgagaagtaaacaatggtttgattatcatgaatgagtttattgtcccatttttgccattattactggtggatgaaatggaagaaaaggatatactagctgtagaagatatgagaaatcgatggtgttcctaccttggtcaagaaatggaaccacacctccaagaaaagctgacagattttttgccaaaactgcttgattgttctatggagattaaaagtttccatgagccaccgaagttaccttcatattccacgcatgaactctgtgagcgatttgcccgaatcatgttgtccctcagtcgaactcctgctgatggaagataaactgcacactttccctgaacacactgtataaactctttttagttcttaacccttgccttcctgtcacagggtttgcttgttgctgctatagtttttaacttttttttattttaataactgcaaaagacaaaatgactatacagactttagtcagactgcagacaataaagctgaaaatcgcatggcgctcagacattttaaccggaactgatgtataatcacaaatctaattgattttattatggcaaaactatgcttttgccaccttcctgttgcagtattactttgcttttatcttttctttctcaacagctttccattcagtctggatccttccatgactacagccatttaagtgttcagcactgtgtacgatacataatatttggtagcttgtaaatgaaataaagaataaagttttatttatggctacctatgtgtttgtaagcaggtatattgtatattagtgtattagtaatactagataaatgaattttgtctggggattaagattggatagttaatagattaatacaatcttttaattctgctctaatgctagcaaattggaaaatgtttaagtctttgacacttaaatttatctatatttttaacaaagttcttgaacttagtatggcaccggaacctgttttgaattcagtcaggtttttactcaagtaagtggttgattttttttaagtcaaactacactgaaacttttatccttttcttagattaatcttactttttaaatgtatttacaatatacagcaaggtgattatttcaagagaatcccaaagtacttgaataagggctattgtaaaatttaaaagaaatatttatatatacacatatatacacatacacacatgtatatatatattcttcataatggaggacaatgttttgcaatatataaatcattctatttttgtaaattgtatatcactttaattgaaaatgttctctactaattaatactgtgaaacaaaattgatgttgtttaactagaagttatgagtatcttaactgcctttattccttttcaaaaaggaaaaagctgtagaacattttgtagatgaaactactgtttaagattaatgaattaatattgtgaatgaaaatcaaaatccatactttaaaggtaatcatgttactaacaacctatttttgaattcataaaaatttctttataaatgatgttttgtgaacatagtaaaatagaccattatactatgtgtatgtttgatacagcgtcgccaaaactagtgttctttattagtgcctctcacaaaagatcctggatggaggagtaagatgaaatattatgctattatatgatgctgtttgtaaaggtattaatgtactagtaaggtgttaatgacaaggaattagtactattcctgttgtaaagttagattttgcatattgtatctatcaaaatatgtttgggtttagattttaagttgtctactgagcagatttctgcattggttttccagtcctgttaaaagtttagaaacttcatatgtgtcatcacagcttttgtaaagaaagtatccttaatattttatgacattct

SEQ ID NO: 76 - DNA, 4642 bp, Homo sapiens
gagaccggtgacccgcggctgggcgcctcggccatgactgcggagctgcagcaggacgacgcggccggcgcggcagacggccacggctcgagctgccaaatgctgttaaatcaactgagagaaatcacaggcattcaggacccttcctttctccatgaagctctgaaggccagtaatggtgacattactcaggcagtcagccttctcactgatgagagagttaaggagcccagtcaagacactgttgctacagaaccatctgaagtagaggggagtgctgccaacaaggaagtattagcaaaagttatagaccttactcatgataacaaagatgatcttcaggctgccattgctttgagtctactggagtctcccaaaattcaagctgatggaagagatcttaacaggatgcatgaagcaacctctgcagaaactaaacgctcaaagagaaaacgctgtgaagtctggggagaaaaccccaatcccaatgactggaggagagttgatggttggccagttgggctgaaaaatgttggcaatacatgttggtttagtgctgttattcagtctctctttcaattgcctgaatttcgaagacttgttctcagttatagtctgccacaaaatgtacttgaaaattgtcgaagtcatacagaaaagagaaatatcatgtttatgcaagagcttcagtatttgtttgctctaatgatgggatcaaatagaaaatttgtagacccgtctgcagccctggatctattaaagggagcattccgatcatctgaggaacagcagcaagatgtgagtgaattcacacacaagctcctggattggctagaggacgcattccagctagctgttaatgttaacagtcccaggaacaaatctgaaaatccaatggtgcagctgttctatggtactttcctgactgaaggggttcgtgaaggaaaacccttttgtaacaatgagaccttcggccagtatcctcttcaggtaaacggttatcgcaacttagacgagtgtttggaaggggccatggtggagggtgatgttgagcttcttccctccgatcactcggtgaagtatggacaagagcgttggtttacaaagctacctccagtgttgacctttgaactctcaagatttgagtttaatcagtcccttgggcagccagagaaaattcacaataagctggaatttcctcagattatttatatggacaggtacatgtacaggagcaaggagcttattcgaaataagagagagtgtattcgaaagttgaaggaggaaataaaaattctgcagcaaaaattggaaaggtatgtgaaatatggctcaggcccagctcggttcccgctcccggacatgctgaaatatgttattgaatttgctagtacaaaacctgcctcagaaagctgtccacctgaaagtgacacacatatgacattaccactttcttcagtgcactgctcggtttctgaccagacatccaaggaaagtacaagtacagaaagctcttctcaggatgttgaaagtaccttttcttctcctgaagattctttacccaagtctaaaccactgacatcttctcggtcttccatggaaatgccttcacagccagctccacgaacagtcacagatgaggagataaattttgttaagacctgtcttcagagatggaggagtgagattgaacaagatatacaagatttaaagacttgtattgcaagtactactcagactattgaacagatgtactgcgatcctctccttcgtcaggtgccttatcgcttgcatgcagttcttgttcatgaaggacaagcaaatgctggacactattgggcctatatctataatcaaccccgacagagctggctcaagtacaatgacatctctgttactgaatcttcctgggaagaagttgaaagagattcctatggaggcctgagaaatgttagtgcttactgtctgatgtacattaatgacaaactaccctacttcaatgcagaggcagccccaactgaatcagatcaaatgtcagaagtggaagccctatctgtggaactcaagcattacattcaggaggataactggcggtttgagcaggaagtagaggagtgggaagaagagcagtcttgcaaaatccctcaaatggagtcctccaccaactcctcatcacaggactactctacatcacaagagccttcagtagcctcttctcatggggttcgctgcttgtcgtctgagcatgctgtgattgtaaaggagcaaactgcccaggctattgcaaacacagcccgtgcctatgagaagagcggtgtagaagcggcactgagtgaggtgatgctgagccctgccatgcaaggggtcatcctggccatagctaaagcccgtcagacctttgaccgagatgggtctgaagcagggctgattaaggcattccatgaagaatactccaggctctatcagcttgccaaagagacccccacctctcacagtgatcctcgacttcagcatgtccttgtctactttttccaaaatgaagcacccaaaagggtagtagaacgaacccttctggaacagtttgcagataaaaatcttagctatgatgaaagatcaatcagcattatgaaggtggctcaagcgaaactgaaggaaattggtccagatgacatgaatatggaagagtacaagaagtggcatgaagattatagtttgttccgaaaagtgtctgtgtatctcctaacaggcctagaactctatcaaaaaggaaagtaccaagaggcactttcctacctggtatatgcctaccagagcaatgctgccctgctgatgaaggggccccgccggggggtcaaagaatccgtgattgctttataccgaagaaaatgccttctggagctgaatgccaaagcagcttctctttttgaaacaaatgatgatcactccgtaactgagggcattaatgtgatgaatgaactgatcatcccctgcattcaccttatcattaataatgacatttccaaggatgatctggatgccattgaggtcatgagaaaccattggtgctcttaccttgggcaagatattgcagaaaatctgcagctgtgcctaggggagtttctacccagacttctagatccttctgcagaaatcatcgtcttgaaagagcctccaactattcgacccaattctccctatgacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttgactgaagatcatccattaatagttattaggcatttaggtaaaattttctaatacctaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaatttttgtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaaaaaaccagcatacatatgcaaaactatatatatatgtatatgtagagaaaaatacttcccattgatcatttttaaaaggcttctgattggatattgtgttttaaccaaattttaaagattaatggaatcatgaaagggaaaaaaattgatacaactatgcagattttataaatgtgcaataaaagtatttgttttaaaaaaaaaaa

SEQ ID NO: 77 - DNA, 3771 bp, Homo sapiens
cagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggtttgggggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagc

SEQ ID NO: 78 - DNA, 5830 bp, Homo sapiens
actgagtcccgggaccccgggagagcggtcagtgtgtggtcgctgcgtttcctctgcctgcgccgggcatcacttgcgcgccgcagaaagtccgtctggcagcctggatatcctctcctaccggcacccgcagacgcccctgcagccgccggtcggcgcccgggctccctagccctgtgcgctcaactgtcctgcgctgcggggtgccgcgagttccacctccgcgcctccttctctagacaggcgctgggagaaagaaccggctcccgagttctgggcatttcgcccggctcgaggtgcaggatgcagagcaaggtgctgctggccgtcgccctgtggctctgcgtggagacccgggccgcctctgtgggtttgcctagtgtttctcttgatctgcccaggctcagcatacaaaaagacatacttacaattaaggctaatacaactcttcaaattacttgcaggggacagagggacttggactggctttggcccaataatcagagtggcagtgagcaaagggtggaggtgactgagtgcagcgatggcctcttctgtaagacactcacaattccaaaagtgatcggaaatgacactggagcctacaagtgcttctaccgggaaactgacttggcctcggtcatttatgtctatgttcaagattacagatctccatttattgcttctgttagtgaccaacatggagtcgtgtacattactgagaacaaaaacaaaactgtggtgattccatgtctcgggtccatttcaaatctcaacgtgtcactttgtgcaagatacccagaaaagagatttgttcctgatggtaacagaatttcctgggacagcaagaagggctttactattcccagctacatgatcagctatgctggcatggtcttctgtgaagcaaaaattaatgatgaaagttaccagtctattatgtacatagttgtcgttgtagggtataggatttatgatgtggttctgagtccgtctcatggaattgaactatctgttggagaaaagcttgtcttaaattgtacagcaagaactgaactaaatgtggggattgacttcaactgggaatacccttcttcgaagcatcagcataagaaacttgtaaaccgagacctaaaaacccagtctgggagtgagatgaagaaatttttgagcaccttaactatagatggtgtaacccggagtgaccaaggattgtacacctgtgcagcatccagtgggctgatgaccaagaagaacagcacatttgtcagggtccatgaaaaaccttttgttgcttttggaagtggcatggaatctctggtggaagccacggtgggggagcgtgtcagaatccctgcgaagtaccttggttacccacccccagaaataaaatggtataaaaatggaataccccttgagtccaatcacacaattaaagcggggcatgtactgacgattatggaagtgagtgaaagagacacaggaaattacactgtcatccttaccaatcccatttcaaaggagaagcagagccatgtggtctctctggttgtgtatgtcccaccccagattggtgagaaatctctaatctctcctgtggattcctaccagtacggcaccactcaaacgctgacatgtacggtctatgccattcctcccccgcatcacatccactggtattggcagttggaggaagagtgcgccaacgagcccagccaagctgtctcagtgacaaacccatacccttgtgaagaatggagaagtgtggaggacttccagggaggaaataaaattgaagttaataaaaatcaatttgctctaattgaaggaaaaaacaaaactgtaagtacccttgttatccaagcggcaaatgtgtcagctttgtacaaatgtgaagcggtcaacaaagtcgggagaggagagagggtgatctccttccacgtgaccaggggtcctgaaattactttgcaacctgacatgcagcccactgagcaggagagcgtgtctttgtggtgcactgcagacagatctacgtttgagaacctcacatggtacaagcttggcccacagcctctgccaatccatgtgggagagttgcccacacctgtttgcaagaacttggatactctttggaaattgaatgccaccatgttctctaatagcacaaatgacattttgatcatggagcttaagaatgcatccttgcaggaccaaggagactatgtctgccttgctcaagacaggaagaccaagaaaagacattgcgtggtcaggcagctcacagtcctagagcgtgtggcacccacgatcacaggaaacctggagaatcagacgacaagtattggggaaagcatcgaagtctcatgcacggcatctgggaatccccctccacagatcatgtggtttaaagataatgagacccttgtagaagactcaggcattgtattgaaggatgggaaccggaacctcactatccgcagagtgaggaaggaggacgaaggcctctacacctgccaggcatgcagtgttcttggctgtgcaaaagtggaggcatttttcataatagaaggtgcccaggaaaagacgaacttggaaatcattattctagtaggcacggcggtgattgccatgttcttctggctacttcttgtcatcatcctacggaccgttaagcgggccaatggaggggaactgaagacaggctacttgtccatcgtcatggatccagatgaactcccattggatgaacattgtgaacgactgccttatgatgccagcaaatgggaattccccagagaccggctgaagctaggtaagcctcttggccgtggtgcctttggccaagtgattgaagcagatgcctttggaattgacaagacagcaacttgcaggacagtagcagtcaaaatgttgaaagaaggagcaacacacagtgagcatcgagctctcatgtctgaactcaagatcctcattcatattggtcaccatctcaatgtggtcaaccttctaggtgcctgtaccaagccaggagggccactcatggtgattgtggaattctgcaaatttggaaacctgtccacttacctgaggagcaagagaaatgaatttgtcccctacaagaccaaaggggcacgattccgtcaagggaaagactacgttggagcaatccctgtggatctgaaacggcgcttggacagcatcaccagtagccagagctcagccagctctggatttgtggaggagaagtccctcagtgatgtagaagaagaggaagctcctgaagatctgtataaggacttcctgaccttggagcatctcatctgttacagcttccaagtggctaagggcatggagttcttggcatcgcgaaagtgtatccacagggacctggcggcacgaaatatcctcttatcggagaagaacgtggttaaaatctgtgactttggcttggcccgggatatttataaagatccagattatgtcagaaaaggagatgctcgcctccctttgaaatggatggccccagaaacaatttttgacagagtgtacacaatccagagtgacgtctggtcttttggtgttttgctgtgggaaatattttccttaggtgcttctccatatcctggggtaaagattgatgaagaattttgtaggcgattgaaagaaggaactagaatgagggcccctgattatactacaccagaaatgtaccagaccatgctggactgctggcacggggagcccagtcagagacccacgttttcagagttggtggaacatttgggaaatctcttgcaagctaatgctcagcaggatggcaaagactacattgttcttccgatatcagagactttgagcatggaagaggattctggactctctctgcctacctcacctgtttcctgtatggaggaggaggaagtatgtgaccccaaattccattatgacaacacagcaggaatcagtcagtatctgcagaacagtaagcgaaagagccggcctgtgagtgtaaaaacatttgaagatatcccgttagaagaaccagaagtaaaagtaatcccagatgacaaccagacggacagtggtatggttcttgcctcagaagagctgaaaactttggaagacagaaccaaattatctccatcttttggtggaatggtgcccagcaaaagcagggagtctgtggcatctgaaggctcaaaccagacaagcggctaccagtccggatatcactccgatgacacagacaccaccgtgtactccagtgaggaagcagaacttttaaagctgatagagattggagtgcaaaccggtagcacagcccagattctccagcctgactcggggaccacactgagctctcctcctgtttaaaaggaagcatccacaccccaactcccggacatcacatgagaggtctgctcagattttgaagtgttgttctttccaccagcaggaagtagccgcatttgattttcatttcgacaacagaaaaaggacctcggactgcagggagccagtcttctaggcatatcctggaagaggcttgtgacccaagaatgtgtctgtgtcttctcccagtgttgacctgatcctcttttttcattcatttaaaaagcattatcatgcccctgctgcgggtctcaccatgggtttagaacaaagagcttcaagcaatggccccatcctcaaagaagtagcagtacctggggagctgacacttctgtaaaactagaagataaaccaggcaacgtaagtgttcgaggtgttgaagatgggaaggatttgcagggctgagtctatccaagaggctttgtttaggacgtgggtcccaagccaagccttaagtgtggaattcggattgatagaaaggaagactaacgttaccttgctttggagagtactggagcctgcaaatgcattgtgtttgctctggtggaggtgggcatggggtctgttctgaaatgtaaagggttcagacggggtttctggttttagaaggttgcgtgttcttcgagttgggctaaagtagagttcgttgtgctgtttctgactcctaatgagagttccttccagaccgttagctgtctccttgccaagccccaggaagaaaatgatgcagctctggctccttgtctcccaggctgatcctttattcagaataccacaaagaaaggacattcagctcaaggctccctgccgtgttgaagagttctgactgcacaaaccagcttctggtttcttctggaatgaataccctcatatctgtcctgatgtgatatgtctgagactgaatgcgggaggttcaatgtgaagctgtgtgtggtgtcaaagtttcaggaaggattttacccttttgttcttccccctgtccccaacccactctcaccccgcaacccatcagtattttagttatttggcctctactccagtaaacctgattgggtttgttcactctctgaatgattattagccagacttcaaaattattttatagcccaaattataacatctattgtattatttagacttttaacatatagagctatttctactgatttttgcccttgttctgtcctttttttcaaaaaagaaaatgtgttttttgtttggtaccatagtgtgaaatgctgggaacaatgactataagacatgctatggcacatatatttatagtctgtttatgtagaaacaaatgtaatatattaaagccttatatataatgaactttgtactattcacattttgtatcagtattatgtagcataacaaaggtcataatgctttcagcaattgatgtcattttattaaagaacattgaaaaacttga

SEQ ID NO: 79 - protein, 480 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASSTA

SEQ ID NO: 80 - protein, 481 aa, Homo sapiens
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 81 - protein, 1620 aa, Homo sapiens [sequence omitted]

SEQ ID NO: 82 - protein, 606 aa, Homo sapiens [sequence omitted]

SEQ ID NO: 83 - protein, 911 aa, Homo sapiens
MGPDRAAPLREPGPGSRHHRARDRLIHFGAVSTDVLGCSAHCSLTQSPKMNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDEDDGRDAAPPGRLPQKLLLETAAPRVSSSRRYSEGREFRYGSWREPVNPYYVNAGYALAPATSANDSEQQSLSSDADTLSLTDSSVDGIPPYRIRKQHRREMQESVQVNGRVPLPHIPRTYRVPKEVRVEPQKFAEELIHRLEAVQRTREAEEKLEERLKRVRMEEEGEDGDPSSGPPGPCHKLPPAPAWHHFPPRCVDMGCAGLRDAHEENPESILDEHVQRVLRTPGRQSPGPGHRSPDSGHVAKMPVALGGAASGHGKHVPKSGAKLDAAGLHHHRHVHHHVHHSTARPKEQVEAEATRRAQSSFAWGLEPHSHGARSRGYSESVGAAPNASDGLAHSGKVGVACKRNAKKAESGKSASTEVPGASEDAEKNQKIMQWIIEGEKEISRHRRTGHGSSGTRKPQPHENSRPLSLEHPWAGPQLRTSVQPSHLFIQDPTMPPHPAPNPLTQLEEARRRLEEEEKRASRAPSKQRYVQEVMRRGRACVRPACAPVLHVVPAVSDMELSETETRSQRKVGGGSAQPCDSIVVAYYFCGEPIPYRTLVRGRAVTLGQFKELLTKKGSYRYYFKKVSDEFDCGVVFEEVREDEAVLPVFEEKIIGKVEKVD

SEQ ID NO: 84 - protein, 843 aa, Homo sapiens
MSSAMLVTCLPDPSSSFREDAPRPPVPGEEGETPPCQPGVGKGQVTKPMSVSSNTRRNEDGLGEPEGRASPDSPLTRWTKSLHSLLGDQDGAYLFRTFLEREKCVDTLDFWFACNGFRQMNLKDTKTLRVAKAIYKRYIENNSIVSKQLKPATKTYIRDGIKKQQIDSIMFDQAQTEIQSVMEENAYQMFLTSDIYLEYVRSGGENTAYMSNGGLGSLKVVCGYLPTLNEEEEWTCADFKCKLSPTVVGLSSKTLRATASVRSTETVDSGYRSFKRSDPVNPYHIGSGYVFAPATSANDSEISSDALTDDSMSMTDSSVDGIPPYRVGSKKQLQREMHRSVKANGQVSLPHFPRTHRLPKEMTPVEPATFAAELISRLEKLKLELESRHSLEERLQQIREDEEREGSELTLNSREGAPTQHPLSLLPSGSYEEDPQTILDDHLSRVLKTPGCQSPGVGRYSPRSRSPDHHHHHHSQYHSLLPPGGKLPPAAASPGACPLLGGKGFVTKQTTKHVHHHYIHHHAVPKTKEEIEAEATQRVHCFCPGGSEYYCYSKCKSHSKAPETMPSEQFGGSRGSTLPKRNGKGTEPGLALPAREGGAPGGAGALQLPREEGDRSQDVWQWMLESERQSKPKPHSAQSTKKAYPLESARSSPGERASRHHLWGGNSGHPRTTPRAHLFTQDPAMPPLTPPNTLAQLEEACRRLAEVSKPPKQRCCVASQQRDRNHSATVQTGATPFSNPSLAPEDHKEPKKLAGVHALQASELVVTYFFCGEEIPYRRMLKAQSLTLGHFKEQLSKKGNYRYYFKKASDEFACGAVFEEIWEDETVLPMYEGRILGKVERID

SEQ ID NO: 85 - protein, 894 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 86 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 87 - protein, 233 aa, Homo sapiens
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 88 - protein, 766 aa, Homo sapiens [sequence omitted]

SEQ ID NO: 89 - protein, 906 aa, Homo sapiens
MAGNVKKSSGAGGGSGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 90 - protein, 982 aa, Homo sapiens [sequence omitted]

SEQ ID NO: 91 - protein, 474 aa, Homo sapiens
MALAVAPWGRQWEEARALGRAVRMLQRLEEQCVDPRLSVSPPSLRDLLPRTAQLLREVAHSRRAAGGGGPGGPGGSGDFLLIYLANLEAKSRQVAALLPPRGRRSANDELFRAGSRLRRQLAKLAIIFSHMHAELHALFPGGKYCGHMYQLTKAPAHTFWRESCGARCVLPWAEFESLLGTCHPVEPGCTALALRTTIDLTCSGHVSIFEFDVFTRLFQPWPTLLKNWQLLAVTHPGYMAFLTYDEVQERLQACRDKPGSYIFRPSCTRLGQWAIGYVSSDGSILQTIPANKPLSQVLLEGQKDGFYLYPDGKTHNPDLTELGQAEPQQRIHVSEEQLQLYWAMDSTFELCKICAESNKDVKIEPCGHLLCSCCLAAWQHSDSQTCPFCRCEIKGWEAVSIYQFYGQATAEDSGNSSDQEGRELELGQVPLSAPPLPPRPDLPPRKPRNAQPKVRLLKGNSPPAALGPQDPAPA

SEQ ID NO: 92 - protein, 173 aa, Homo sapiens
MGRGRCVGPSLQLRGQEWRCSPLVPKGGAAAAELGPGGGENMVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 93 - protein, 156 aa, Homo sapiens
MEPAAGSSMEPSADWLATAAARGRVEEVRALLEAGALPNAPNSYGRRPIQVMMMGSARVAELLLLHGAEPNCADPATLTRPVHDAAREGFLDTLVVLHRAGARLDVRDAWGRLPVDLAEELGHRDVARYLRAAAGGTRGSNHARIDAAEGPSDIPD

SEQ ID NO: 94 - protein, 1036 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 95 - protein, 1036 aa, Homo sapiens; identical to SEQ ID NO: 94

SEQ ID NO: 96 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 97 - protein, 352 aa, Homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 98 - protein, 855 aa, Homo sapiens
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 99 - protein, 288 aa, Homo sapiens
MDDPKSEQQRILRRHQRERQELQAQIRSLKNSVPKTDKTKRKQLLQDVARMEAEMAQKHRQELEKFQDDSSIESVVEDLAKMNLENRPPRSSKAHRKRERMESEERERQESIFQAEMSEHLAGFKREEEEKLAAILGARGLEMKAIPADGHCMYRAIQDQLVFSVSVEMLRCRTASYMKKHVDEFLPFFSNPETSDSFGYDDFMIYCDNIVRTTAWGGQLELRALSHVLKTPIEVIQADSPTLIIGEEYVKKPIILVYLRYAYSLGEHYNSVTPLEAGAAGGVLPRLL

SEQ ID NO: 100 - protein, 382 aa, Homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 101 - protein, 594 aa, Homo sapiens
MTDKSIVILSLMVFHSSFINGKTCRRQLVEEWHPQPSSYVVNWTLTENICLDFYRDCWFLGVNTKIDTSGNQAVPQICPLQIQLGDILVISSEPSLQFPEINLMNVSETSFVGCVQNTTTEDQLLFGCRLKGMHTVNSKWLSVGTHYFITVMASGPSPCPLGLRLNVTVKQQFCQESLSSEFCSGHGKCLSEAWSKTYSCHCQPPFSGKYCQELDACSFKPCKNNGSCINKRENWDEQAYECVCHPPFTGKNCSEIIGQCQPHVCFHGNCSNITSNSFICECDEQFSGPFCEVSAKPCVSLLFWKRGICPNSSSAYTYECPKGSSSQNGETDVSEFSLVPCQNGTDCIKISNDVMCICSPIFTDLLCKSIQTSCESFPLRNNATCKKCEKDYPCSCISGFTEKNCEKAIDHCKLLSINCLNEEWCFNIIGRFKYVCIPGCTKNPCWFLKNVYLIHQHLCYCGVTFHGICQDKGPAQFEYVWQLGFAGSEGEKCQGVIDAYFFLAANCTEDATYVNDPEDNNSSCWFPHEGTKEICANGCSCLSEEDSQEYRYLCFLRWAGNMYLENTTDDQENECQHEAVCKDEINRPRYLCII

SEQ ID NO: 102 - protein, 1210 aa, Homo sapiens [sequence omitted]

SEQ ID NO: 103 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 104 - protein, 1308 aa, Homo sapiens
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 105 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 106 - protein, 822 aa, Homo sapiens [sequence omitted]

SEQ ID NO: 107 - protein, 840 aa, Homo sapiens [sequence omitted]

SEQ ID NO: 108 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 109 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 110 - protein, 2549 aa, Homo sapiens
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 111 - protein, 393 aa, Homo sapiens
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 112 - protein, 1255 aa, Homo sapiens [sequence omitted]

SEQ ID NO: 113 - protein, 1367 aa, Homo sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 114 - protein, 1218 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 115 - protein, 1238 aa, Homo sapiens
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 116 - protein, 1132 aa, Homo sapiens
MGMACLTMTEMEGTSTSSIYQNGDISGNANSMKQIDPVLQVYLYHSLGKSEADYLTFPSGEYVAEEICIAASKACGITPVYHNMFALMSETERIWYPPNHVFHIDESTRHNVLYRIRFYFPRWYCSGSNRAYRHGISRGAEAPLLDDFVMSYLFAQWRHDFVHGWIKVPVTHETQEECLGMAVLDMMRIAKENDQTPLAIYNSISYKTFLPKCIRAKIQDYHILTRKRIRYRFRRFIQQFSQCKATARNLKLKYLINLETLQSAFYTEKFEVKEPGSGPSGEEIFATIIITGNGGIQWSRGKHKESETLTEQDLQLYCDFPNIIDVSIKQANQEGSNESRVVTIHKQDGKNLEIELSSLREALSFVSLIDGYYRLTADAHHYLCKEVAPPAVLENIQSNCHGPISMDFAISKLKKAGNQTGLYVLRCSPKDFNKYFLTFAVERENVIEYKHCLITKNENEEYNLSGTKKNFSSLKDLLNCYQMETVRSDNIIFQFTKCCPPKPKDKSNLLVFRTNGVSDVPTSPTLQRPTHMNQMVFHKIRNEDLIFNESLGQGTFTKIFKGVRREVGDYGQLHETEVLLKVLDKAHRNYSESFFEAASMMSKLSHKHLVLNYGVCVCGDENILVQEFVKFGSLDTYLKKNKNCINILWKLEVAKQLAWAMHFLEENTLIHGNVCAKNILLIREEDRKTGNPPFIKLSDPGISITVLPKDILQERIPWVPPECIENPKNLNLATDKWSFGTTLWEICSGGDKPLSALDSQRKLQFYEDRHQLPAPKWAELANLINNCMDYEPDFRPSFRAIIRDLNSLFTPDYELLTENDMLPNMRIGALGFSGAFEDRDPTQFEERHLKFLQQLGKGNFGSVEMCRYDPLQDNTGEVVAVKKLQHSTEEHLRDFEREIEILKSLQHDNIVKYKGVCYSAGRRNLKLIMEYLPYGSLRDYLQKHKERIDHIKLLQYTSQICKGMEYLGTKRYIHRDLATRNILVENENRVKIGDFGLTKVLPQDKEYYKVKEPGESPIFWYAPESLTESKFSVASDVWSFGVVLYELFTYIEKSKSPPAEFMRMIGNDKQGQMIVFHLIELLKNNGRLPRPDGCPDEIYMIMTECWNNNVNQRPSFRDLALRVDQIRDNMAG

SEQ ID NO: 117 - protein, 188 aa, Homo sapiens [sequence omitted]

SEQ ID NO: 118 - protein, 393 aa, Homo sapiens [sequence omitted]

SEQ ID NO: 119 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 120 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 121 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPVAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 122 - protein, 923 aa, Homo sapiens
MERGLPLLCAVLALVLAPAGAFRNDECGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFAPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLEPILITIIAMSALGVLLGAVCGVVLYCACWHNGMSERNLSALENYNFELVDGVKLKKDKLNTQSTYSEA

SEQ ID NO: 123 - protein, 2556 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQAGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 124 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 125 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 126 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 127 - protein, 470 aa, Homo sapiens
MCLLESLDCFLTVTPISPFLPGGALDKERTPPPTLSNGHRKQDFSLFVMLEFQRTLVKLHSTLQLGWRNETEHQLMKELSVKCFMHRATDAQQISDEIQGWALSDTAFGILRKLVYKSLKGFLAFPQARYLPNGIGQRCKVGFVLARQENPLADSPLPELLRPDCPEPAGLDATREGPDRNFRLSEHRQALAAAKHRGPAATPGSPDPGPGPWGEEHLAERGPRGWERGGDRCDAPGGDAARRPDPEAEAPPAGSIEAAPSSAAEPVIVSRSDPRDEKLALYLAEVEKQDKYLRQRNKYRFHIIPDGNCLYRAVSKTVYGDQSLHRELREQTVHYIADHLDHFSPLIEGDVGEFIIAAAQDGAWAGYPELLAMGQMLNVNIHLTTGGRLESPTVSTMIHYLGPEDSLRPSIWLSWLSNGHYDAVFDHSYPNPEYDNWCKQTQVQRKRDEELAKSMAISLSKMYIEQNACS

SEQ ID NO: 128 - protein, 681 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 129 - protein, 1106 aa, Homo sapiens
MRLPGAMPALALKGELLLLSLLLLLEPQISQGLVVTPPGPELVLNVSSTFVLTCSGSAPVVWERMSQEPPQEMAKAQDGTFSSVLTLTNLTGLDTGEYFCTHNDSRGLETDERKRLYIFVPDPTVGFLPNDAEELFIFLTEITEITIPCRVTDPQLVVTLHEKKGDVALPVPYDHQRGFSGIFEDRSYICKTTIGDREVDSDAYYVYRLQVSSINVSVNAVQTVVRQGENITLMCIVIGNEVVNFEWTYPRKESGRLVEPVTDFLLDMPYHIRSILHIPSAELEDSGTYTCNVTESVNDHQDEKAINITVVESGYVRLLGEVGTLQFAELHRSRTLQVVFEAYPPPTVLWFKDNRTLGDSSAGEIALSTRNVSETRYVSELTLVRVKVAEAGHYTMRAFHEDAEVQLSFQLQINVPVRVLELSESHPDSGEQTVRCRGRGMPQPNIIWSACRDLKRCPRELPPTLLGNSSEEESQLETNVTYWEEEQEFEVVSTLRLQHVDRPLSVRCTLRNAVGQDTQEVIVVPHSLPFKVVVISAILALVVLTIISLIILIMLWQKKPRYEIRWKVIESVSSDGHEYIYVDPMQLPYDSTWELPRDQLVLGRTLGSGAFGQVVEATAHGLSHSQATMKVAVKMLKSTARSSEKQALMSELKIMSHLGPHLNVVNLLGACTKGGPIYIITEYCRYGDLVDYLHRNKHTFLQHHSDKRRPPSAELYSNALPVGLPLPSHVSLTGESDGGYMDMSKDESVDYVPMLDMKGDVKYADIESSNYMAPYDNYVPSAPERTCRATLINESPVLSYMDLVGFSYQVANGMEFLASKNCVHRDLAARNVLICEGKLVKICDFGLARDIMRDSNYISKGSTFLPLKWMAPESIFNSLYTTLSDVWSFGILLWEIFTLGGTPYPELPMNEQFYNAIKRGYRMAQPAHASDEIYEIMQKCWEEKFEIRPPFSQLVLLLERLLGEGYKKKYQQVDEEFLRSDHPAILRSQARLPGFHGLRSPLDTSSVLYTAVQPNEGDNDYIIPLPDPKPEVADEGPLEGSPSLASSTLNEVNTSSTISCDSPLEPQDEPEPEPQLELQVEPEPELEQLPDSGCPAPRAEAEDSFL

SEQ ID NO: 130 - protein, 436 aa, Homo sapiens
MRLARLLRGAALAGPGPGLRAAGFSRSFSSDSGSSPASERGVPGQVDFYARFSPSPLSMKQFLDFGSVNACEKTSFMFLRQELPVRLANIMKEISLLPDNLLRTPSVQLVQSWYIQSLQELLDFKDKSAEDAKAIYDFTDTVIRIRNRHNDVIPTMAQGVIEYKESFGVDPVTSQNVQYFLDRFYMSRISIRMLLNQHSLLFGGKGKGSPSHRKHIGSINPNCNVLEVIKDGYENARRLCDLYYINSPELELEELNAKSPGQPIQVVYVPSHLYHMVFELFKNAMRATMEHHANRGVYPPIQVHVTLGNEDLTVKMSDRGGGVPLRKIDRLFNYMYSTAPRPRVETSRAVPLAGFGYGLPISRLYAQYFQGDLKLYSLEGYGTDAVIYIKALSTDSIERLPVYNKAAWKHYNTNHEADDWCVPSREPKDMTTFRSA

SEQ ID NO: 131 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 132 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 133 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVARRAPALGPAVRALGATFGPLLLRAPPPPSSPPPGGAPDGSEPSPDFPALLVEKLLQEHLEEQEVAPPALPPKPPKAKPAPTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 134 - protein, 1358 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 135 - protein, 880 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRTKLQAVGEKAGFPGVLDTAKPGKLHTIPIPVARCYTYSWSQDSFDILQEILLKEQELLQPGILGDDEEEEEEEEEVEEDLETDGHCAERDSLLSTSSLASHDSTLSLASSQASGPALSRHLLTSFVSGLSDGMDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQLYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRCEVSPCYKPEKSDLSSPPQTPPDLPAQAAPDLCSLLCLPIMTFSGALP

SEQ ID NO: 136 - protein, 603 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSCLKETYLRIKKNEYSIPKHINPVAASLIQKMLQTDPTARPTINELLNDEFFTSGYIPARLPITCLTIPPRFSIAPSSLDPSNRKPLTVLNKGLENPLPERPREKEEPVVRETGEVVDCHLSDMLQQLHSVNASKPSERGLVRQEEAEDPACIPIFWVSKWVDYSDKYGLGYQLCDNSVGVLFNDSTRLILYNDGDSLQYIERDGTESYLTVSSHPNSLMKKITLLKYFRNYMSEHLLKAGANITPREGDELARLPYLRTWFRTRSAIILHLSNGSVQINFFQDHTKLILCPLMAAVTYIDEKRDFRTYRLSLLEEYGCCKELASRLRYARTMVDKLLSSRSASNRLKAS

SEQ ID NO: 137 - protein, 671 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKARDKRDTSNFDKEFTRQPVELTPTDKLFIMNLDQNEFAGFSYTNPEFVINV

SEQ ID NO: 138 - protein, 587 aa, Homo sapiens
MSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 139 - protein, 1447 aa, Homo sapiens
MASAGNAAEPQDRGGGGSGCIGAPGRPAGGGRRRRTGGLRRAAAPDRDYLHRPSYCDAAFALEQISKGKATGRKAPLWLRAKFQRLLFKLGCYIQKNCGKFLVVGLLIFGAFAVGLKAANLETNVEELWVEVGGRVSRELNYTRQKIGEEAMFNPQLMIQTPKEEGANVLTTEALLQHLDSALQASRVHVYMYNRQWKLEHLCYKSGELITETGYMDQIIEYLYPCLIITPLDCFWEGAKLQSGTAYLLGKPPLRWTNFDPLEFLEELKKINYQVDSWEEMLNKAEVGHGYMDRPCLNPADPDCPATAPNKNSTKPLDMALVLNGGCHGLSRKYMHWQEELIVGGTVKNSTGKLVSAHALQTMFQLMTPKQMYEHFKGYEYVSHINWNEDKAAAILEAWQRTYVEVVHQSVAQNSTQKVLSFTTTTLDDILKSFSDVSVIRVASGYLLMLAYACLTMLRWDCSKSQGAVGLAGVLLVALSVAAGLGLCSLIGISFNAATTQVLPFLALGVGVDDVFLLAHAFSETGQNKRIPFEDRTGECLKRTGASVALTSISNVTAFFMAALIPIPALRAFSLQAAVVVVFNFAMVLLIFPAILSMDLYRREDRRLDIFCCFTSPCVSRVIQVEPQAYTDTHDNTRYSPPPPYSSHSFAHETQITMQSTVQLRTEYDPHTHVYYTTAEPRSEISVQPVTVTQDTLSCQSPESTSSTRDLLSQFSDSSLHCLEPPCTKWTLSSFAEKHYAPFLLKPKAKVVVIFLFLGLLGVSLYGTTRVRDGLDLTDIVPRETREYDFIAAQFKYFSFYNMYIVTQKADYPNIQHLLYDLHRSFSNVKYVMLEENKQLPKMWLHYFRDWLQGLQDAFDSDWETGKIMPNNYKNGSDDGVLAYKLLVQTGSRDKPIDISQLTKQRLVDADGIINPSAFYIYLTAWVSNDPVAYAASQANIRPHRPEWVHDKADYMPETRLRIPAAEPIEYAQFPFYLNGLRDTSDFVEAIEKVRTICSNYTSLGLSSYPNGYPFLFWEQYIGLRHWLLLFISVVLACTFLVCAVFLLNPWTAGIIVMVLALMTVELFGMMGLIGIKLSAVPVVILIASVGIGVEFTVHVALAFLTAIGDKNRRAVLALEHMFAPVLDGAVSTLLGVLMLAGSEFDFIVRYFFAVLAILTILGVLNGLVLLPVLLSFFGPYPEVSPANGLNRLPTPSPEPPPSVVRFAMPPGHTHSGSDSSDSEYSSQTTVSGLSEELRHYEAQQGAGGPAHQVIVEATENPVFAHSTVVHPESRHHPPSNPRQQPHLDSGSLPPGRQGQQPRRDPPREGLWPPLYRPRRDAFEISTEGHSGPSNRARWGPRGARSHNPRNPASTAMGSSVPGYCQPITTVTASASVTVAVHPPPVPGPGRNPRGGLCPGYPETDHGLFEDPHVPFHVRCERRDSKVEVIELQDVECEERPRGSSSN

SEQ ID NO: 140 - protein, 402 aa, Homo sapiens [sequence omitted]

SEQ ID NO: 141 - protein, 928 aa, Homo sapiens
MPPKTPRKTAATAAAAAAEPPAPPPPPPPEEDPEQDSGPEDLPLVRLEFEETEEPDFTALCQKLKIPDHVRERAWLTWEKVSSVDGVLGGYIQKKKELWGICIFIARVDLDEMSFTLLSYRKTYEISVHKFFNLLKEIDTSTKVDNAMSRLLKKYDVLFALFSKLERTCELIYLTQPSSSISTEINSALVLKVSWITFLLAKGEVLQMEDDLVISFQLMLCVLDYFIKLSPPMLLKEPYKTAVIPINGSPRTPRRGQNRSARIAKQLENDTRIIEVLCKEHECNIDEVKNVYFKNFIPFMNSLGLVTSNGLPEVENLSKRYEEIYLKNKDLDRRLFLDHDKTLQTDSIDSFETQRTPRKSNLDEEVNIIPPHTPVRTVMNTIQQLMMILNSASDQPSENLISYFNNCTVNPKESILKRVKDIGYIFKEKFAKAVGQGCVEIGSQRYKLGVRLYYRVMESMLKSEEERLSIQNFSKLLNDNIFHMSLLACALEVVMATYSRSTSQNLDSGTDLSFPWILNVLNLKAFDFYKVIESFIKAEGNLTREMIKHLERCEHRIMESLAWLSDSPLFDLIKQSKDREGPTDHLESACPLNLPLQNNHTAADMYLSPVRSPKKKGSTTRVNSTANAETQATSAFQTQKPLKSTSLSLFYKKVYRLAYLRLNTLCERLLSEHPELEHIIWTLFQHTLQNEYELMRDRHLDQIMMCSMYGICKVKNIDLKFKIIVTAYKDLPHAVQETFKRVLIKEEEYDSIIVFYNSVFMQRLKTNILQYASTRPPTLSPIPHIPRSPYKFPSSPLRIPGGNIYISPLKSPYKISEGLPTPTKMTPRSRILVSIGESFGTSEKFQKINQMVCNSDRVLKRSAEGSNPPKPLKKLRFDIEGSDEADGSKHLPGESKFQQKLAEMTSTRTRMQKQKMNDSMDTSNKEEK

SEQ ID NO: 142 - protein, 330 aa, Homo sapiens
MDTETTALCPSGSRRASPPGTPTPEADATLLKKSEKLLAELDRSGLPSAPGAPRRRGSMPVPYKHQLRRAQAVDELDWPPQASSSGSSDSLGSGEAAPAQKDGIFKVMLVGESGVGKSTLAGTFGGLQGDSAHEPENPEDTYERRIMVDKEEVTLVVYDIWEQGDAGGWLRDHCLQTGDAFLIVFSVTDRRSFSKVPETLLRLRAGRPHHDLPVILVGNKSDLARSREVSLEEGRHLAGTLSCKHIETSAALHHNTRELFEGAVRQIRLRRGRNHAGGQRPDPGSPEGPAPPARRESLTKKAKRFLANLVPRNAKFFKQRSRSCHDLSVL

SEQ ID NO: 143 - protein, 1072 aa, Homo sapiens
MAKATSGAAGLRLLLLLLLPLLGKVALGLYFSRDAYWEKLYVDQAAGTPLLYVHALRDAPEEVPSFRLGQHLYGTYRTRLHENNWICIQEDTGLLYLNRSLDHSSWEKLSVRNRGFPLLTVYLKVFLSPTSLREGECQWPGCARVYFSFFNTSFPACSSLKPRELCFPETRPSFRIRENRPPGTFHQFRLLPVQFLCPNISVAYRLLEGEGLPFRCAPDSLEVSTRWALDREQREKYELVAVCTVHAGAREEVVMVPFPVTVYDEDDSAPTFPAGVDTASAVVEFKRKEDTVVATLRVFDADVVPASGELVRRYTSTLLPGDTWAQQTFRVEHWPNETSVQANGSFVRATVHDYRLVLNRNLSISENRTMQLAVLVNDSDFQGPGAGVLLLHFNVSVLPVSLHLPSTYSLSVSRRARRFAQIGKVCVENCQAFSGINVQYKLHSSGANCSTLGVVTSAEDTSGILFVNDTKALRRPKCAELHYMVVATDQQTSRQAQAQLLVTVEGSYVAEEAGCPLSCAVSKRRLECEECGGLGSPTGRCEWRQGDGKGITRNFSTCSPSTKTCPDGHCDVVETQDINICPQDCLRGSIVGGHEPGEPRGIKAGYGTCNCFPEEEKCFCEPEDIQDPLCDELCRTVIAAAVLFSFIVSVLLSAFCIHCYHKFAHKPPISSAEMTFRRPAQAFPVSYSSSGARRPSLDSMENQVSVDAFKILEDPKWEFPRKNLVLGKTLGEGEFGKVVKATAFHLKGRAGYTTVAVKMLKENASPSELRDLLSEFNVLKQVNHPHVIKLYGACSQDGPLLLIVEYAKYGSLRGFLRESRKVGPGYLGSGGSRNSSSLDHPDERALTMGDLISFAWQISQGMQYLAEMKLVHRDLAARNILVAEGRKMKISDFGLSRDVYEEDSYVKRSQGRIPVKWMAIESLFDHIYTTQSDVWSFGVLLWEIVTLGGNPYPGIPPERLFNLLKTGHRMERPDNCSEEMYRLMLQCWKQEPDKRPVFADISKDLEKMMVKRRDYLDLAASTPSDSLIYDDGLSEEETPLVDCNNAPLPRALPSTWIENKLYGRISHAFTRF

SEQ ID NO: 144 - protein, 1400 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 145 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 146 - protein, 403 aa, Homo sapiens
MDRSKENCISGPVKATAPVGGPKRVLVTQQFPCQNPLPVNSGQAQRVLCPSNSSQRIPLQAQKLVSSHKPVQNQKQKQLQATSVPHPVSRPLNNTQKSKQPLPSAPENNPEEELASKQKNEESKKRQWALEDFEIGRPLGKGKFGNVYLAREKQSKFILALKVLFKAQLEKAGVEHQLRREVEIQSHLRHPNILRLYGYFHDATRVYLILEYAPLGTVYRELQKLSKFDEQRTATYITELANALSYCHSKRVIHRDIKPENLLLGSAGELKIADFGWSVHAPSSRRTTLCGTLDYLPPEMIEGRMHDEKVDLWSLGVLCYEFLVGKPPFEANTYQETYKRISRVEFTFPDFVTEGARDLISRLLKHNPSQRPMLREVLEHPWITANSSKPSNCQNKESASKQS

SEQ ID NO: 147 - protein, 484 aa, Homo sapiens
MAELRPSGAPGPTAPPAPGPTAPPAFASLFPPGLHAIYGECRRLYPDQPNPLQVTAIVKYWLGGPDPLDYVSMYRNVGSPSANIPEHWHYISFGLSDLYGDNRVHEFTGTDGPSGFGFELTFRLKRETGESAPPTWPAELMQGLARYVFQSENTFCSGDHVSWHSPLDNSESRIQHMLLTEDPQMQPVQTPFGVVTFLQIVGVCTEELHSAQQWNGQGILELLRTVPIAGGPWLITDMRRGETIFEIDPHLQERVDKGIETDGSNLSGVSAKCAWDDLSRPPEDDEDSRSICIGTQPRRLSGKDTEQIRETLRRGLEINSKPVLPPINPQRQNGLAHDRAPSRKDSLESDSSTAIIPHELIRTRQLESVHLKFNQESGALIPLCLRGRLLHGRHFTYKSITGDMAITFVSTGVEGAFATEEHPYAAHGPWLQILLTEEFVEKMLEDLEDLTSPEEFKLPKEYSWPEKKLKVSILPDVVFDSPLH

SEQ ID NO: 148 - protein, 503 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTVKSSPGLGPVELAAVIAGPVCFVCISLMLMVYICHNRTVIHHRVPNEEDPSLDRPFISEGTTLKDLIYDMTTSGSGSGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHRDLKSKNILVKKNGTCCIADLGLAVRHDSATDTIDIAPNHRVGTKRYMAPEVLDDSINMKHFESFKRADIYAMGLVFWEIARRCSIGGIHEDYQLPYYDLVPSDPSVEEMRKVVCEQKLRPNIPNRWQSCEALRVMAKIMRECWYANGAARLTALRIKKTLSQLSQQEGIKM

SEQ ID NO: 149 - protein, 567 aa, Homo sapiens
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSTWETGKTRKLMEFSEHCAIILEDDRSDISSTCANNINHNTELLPIELDTLVGKGRFAEVYKAKLKQNTSEQFETVAVKIFPYEEYASWKTEKDIFSDINLKHENILQFLTAEERKTELGKQYWLITAFHAKGNLQEYLTRHVISWEDLRKLGSSLARGIAHLHSDHTPCGRPKMPIVHRDLKSSNILVKNDLTCCLCDFGLSLRLDPTLSVDDLANSGQVGTARYMAPEVLESRMNLENAESFKQTDVYSMALVLWEMTSRCNAVGEVKDYEPPFGSKVREHPCVESMKDNVLRDRGRPEIPSFWLNHQGIQMVCETLTECWDHDPEARLTAQCVAERFSELEHLDRLSGRSCSEEKIPEDGSLNTTK

SEQ ID NO: 150 - protein, 393 aa, Homo sapiens [sequence omitted]

SEQ ID NO: 151 - protein, 381 aa, Homo sapiens
MISARSSEPFYSDDKMAHHTLLLGSGHVGLRNLGNTCFLNAVLQCLSSTRPLRDFCLRRDFRQEVPGGGRAQELTEAFADVIGALWHLDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVFLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 152 - protein, 1556 aa, Homo sapiens
MEQEKSLPGVVMALVCNVFDMLYQLANLEEPRITLRVRKLLLLIPTDPAIQEALDQLDSLGRKKTLLSESSSQSSKSPSLSSKQQHQPSASSILESLFRSFAPGMSTFRVLYNLEVLSSKLMPTADDDMARSCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 153 - protein, 1055 aa, Homo sapiens
MTVEQNVLQQSAAQKHQQTFLNQLREITGINDTQILQQALKDSNGNLELAVAFLTAKNAKTPQQEETTYYQTALPGNDRYISVGSQADTNVIDLTGDDKDDLQRAIALSLAESNRAFRETGITDEEQAISRVLEASIAENKACLKRTPTEVWRDSRNPYDRKRQDKAPVGLKNVGNTCWFSAVIQSLFNLLEFRRLVLNYKPPSNAQDLPRNQKEHRNLPFMRELRYLFALLVGTKRKYVDPSRAVEILKDAFKSNDSQQQDVSEFTHKLLDWLEDAFQMKAEEETDEEKPKNPMVELFYGRFLAVGVLEGKKFENTEMFGQYPLQVNGFKDLHECLEAAMIEGEIESLHSENSGKSGQEHWFTELPPVLTFELSRFEFNQALGRPEKIHNKLEFPQVLYLDRYMHRNREITRIKREEIKRLKDYLTVLQQRLERYLSYGSGPKRFPLVDVLQYALEFASSKPVCTSPVDDIDASSPPSGSIPSQTLPSTTEQQGALSSELPSTSPSSVAAISSRSVIHKPFTQSRIPPDLPMHPAPRHITEEELSVLESCLHRWRTEIENDTRDLQESISRIHRTIELMYSDKSMIQVPYRLHAVLVHEGQANAGHYWAYIFDHRESRWMKYNDIAVTKSSWEELVRDSFGGYRNASAYCLMYINDKAQFLIQEEFNKETGQPLVGIETLPPDLRDFVEEDNQRFEKELEEWDAQLAQKALQEKLLASQKLRESETSVTTAQAAGDPEYLEQPSRSDFSKHLKEETIQIITKASHEHEDKSPETVLQSAIKLEYARLVKLAQEDTPPETDYRLHHVVVYFIQNQAPKKIIEKTLLEQFGDRNLSFDERCHNIMKVAQAKLEMIKPEEVNLEEYEEWHQDYRKFRETTMYLIIGLENFQRESYIDSLLFLICAYQNNKELLSKGLYRGHDEELISHYRRECLLKLNEQAAELFESGEDREVNNGLIIMNEFIVPFLPLLLVDEMEEKDILAVEDMRNRWCSYLGQEMEPHLQEKLTDFLPKLLDCSMEIKSFHEPPKLPSYSTHELCERFARIMLSLSRTPADGR

SEQ ID NO: 154 - protein, 1088 aa, Homo sapiens
ETGDPRLGASAMTAELQQDDAAGAADGHGSSCQMLLNQLREITGIQDPSFLHEALKASNGDITQAVSLLTDERVKEPSQDTVATEPSEVEGSAANKEVLAKVIDLTHDNKDDLQAAIALSLLESPKIQADGRDLNRMHEATSAETKRSKRKRCEVWGENPNPNDWRRVDGWPVGLKNVGNTCWFSAVIQSLFQLPEFRRLVLSYSLPQNVLENCRSHTEKRNIMFMQELQYLFALMMGSNRKFVDPSAALDLLKGAFRSSEEQQQDVSEFTHKLLDWLEDAFQLAVNVNSPRNKSENPMVQLFYGTFLTEGVREGKPFCNNETFGQYPLQVNGYRNLDECLEGAMVEGDVELLPSDHSVKYGQERWFTKLPPVLTFELSRFEFNQSLGQPEKIHNKLEFPQIIYMDRYMYRSKELIRNKRECIRKLKEEIKILQQKLERYVKYGSGPARFPLPDMLKYVIEFASTKPASESCPPESDTHMTLPLSSVHCSVSDQTSKESTSTESSSQDVESTFSSPEDSLPKSKPLTSSRSSMEMPSQPAPRTVTDEEINFVKTCLQRWRSEIEQDIQDLKTCIASTTQTIEQMYCDPLLRQVPYRLHAVLVHEGQANAGHYWAYIYNQPRQSWLKYNDISVTESSWEEVERDSYGGLRNVSAYCLMYINDKLPYFNAEAAPTESDQMSEVEALSVELKHYIQEDNWRFEQEVEEWEEEQSCKIPQMESSTNSSSQDYSTSQEPSVASSHGVRCLSSEHAVIVKEQTAQAIANTARAYEKSGVEAALSEVMLSPAMQGVILAIAKARQTFDRDGSEAGLIKAFHEEYSRLYQLAKETPTSHSDPRLQHVLVYFFQNEAPKRVVERTLLEQFADKNLSYDERSISIMKVAQAKLKEIGPDDMNMEEYKKWHEDYSLFRKVSVYLLTGLELYQKGKYQEALSYLVYAYQSNAALLMKGPRRGVKESVIALYRRKCLLELNAKAASLFETNDDHSVTEGINVMNELIIPCIHLIINNDISKDDLDAIEVMRNHWCSYLGQDIAENLQLCLGEFLPRLLDPSAEIIVLKEPPTIRPNSPYDLCSRFAAVMESIQGVSTVTVK

SEQ ID NO: 155 - protein, 773 aa, Homo sapiens
PLGCPHPSILGVPCPCVTVTPLTRMIDWVSWPLGKNIDKWIIALLKGLAAVKKFSILIEVSLTKIEKVFSKLLYPIVRGAALSVLKYMLLTFQHSHEAFHLLLPHIPPMVASLVKEDSNSGTSCLEQLAELVHCMVFRFPGFPDLYEPVMEAIKDLHVPNEDRIKQLLGQDAWTSQKSELAGFYPRLMAKSDTGKIGLINLGNTCYVNSILQALFMASDFRHCVLRLTENNSQPLMTKLQWLFGFLEHSQRPAISPENFLSASWTPWFSPGTQQDCSEYLKYLLDRLHEEEKTGTRICQKLKQSSSPSPPEEPPAPSSTSVEKMFGGKIVTRICCLCCLNVSSREEAFTDLSLAFPPPERCRRRRLGSVMRPTEDITARELPPPTSAQGPGRVGPRRQRKHCITEDTPPTSLYIEGLDSKEAGGQSSQEERIEREEEGKEERTEKEEVGEEEESTRGEGEREKEEEVEEEEEKVEKETEKEAEQEKEEDSLGAGTHPDAAIPSGERTCGSEGSRSVLDLVNYFLSPEKLTAENRYYCESCASLQDAEKVVELSQGPCYLILTLLRFSFDLRTMRRRKILDDVSIPLLLRLPLAGGRGQAYDLCSVVVHSGVSSESGHYYCYAREGAARPAASLGTADRPEPENQWYLFNDTRVSFSSFESVSNVTSFFPKDTAYVLFYRQRPREGPEAELGSSRVRTEPTLHKDLMEAISKDNILYLQEQEKEARSRAAYISALPTSPHWGRGFDEDKDEDEGSPGGCNPAGGNGGDFHRLVF

SEQ ID NO: 156 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

What is claimed is:

1. A method of treating a tumor comprising an amino acid substitution in an SH2 domain of a PIK3R1 polypeptide, wherein the amino acid substitution results in activation of a PIK3CA polypeptide, wherein the amino acid substitution is at 564N, the method comprising administering to a human subject having the tumor with said PIK3R1 substitution at amino acid 564N an effective amount of a pharmaceutical formulation comprising an antagonist of PI3K signaling.

2. The method of claim 1, wherein the tumor is a solid tumor.

3. The method of claim 1, wherein the tumor is a colon tumor.

4. The method of claim 1, wherein the amino acid substitution is 564N>D.

5. The method of claim 1, wherein the antagonist is an antagonist of a PIK3CA polypeptide.

6. A method of treating a tumor comprising an amino acid substitution in an SH2 domain of a PIK3R1 polypeptide, wherein the amino acid substitution is at 564N, the method comprising administering to a human subject having the tumor with said PIK3R1 substitution at amino acid 564N an effective amount of a pharmaceutical formulation comprising an antagonist of PI3K signaling.

7. The method of claim 6, wherein the tumor is a solid tumor.

8. The method of claim 6, wherein the tumor is a colon tumor.

9. The method of claim 6, wherein the amino acid substitution is 564N>D.

10. The method of claim 6, wherein the antagonist is an antagonist of a PIK3CA polypeptide.

\* \* \* \* \*

UNITED STATES PATENT AND TRADEMARK OFFICE
CERTIFICATE OF CORRECTION

PATENT NO.       : 8,680,041 B2
APPLICATION NO.  : 12/446907
DATED            : March 25, 2014
INVENTOR(S)      : Kan et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 1078 days.

Signed and Sealed this
Twenty-ninth Day of September, 2015

Michelle K. Lee
*Director of the United States Patent and Trademark Office*